United States Patent 9,782,462 (MODIFIED POLYNUCLEOTIDES FOR THE PRODUCTION OF PROTEINS ASSOCIATED WITH HUMAN DISEASE) - sequence listing, part 37

SEQ ID NO: 60318 - protein, 950 aa, Homo sapiens
MLYSSRGDPEGQPLLLSLLILAMWVVGSGQLHYSVPEEAEHGTFVGRIAQDLGLELAELVPRLFQLDSKGRGDLLEVNLQNGILFVNSRIDREELCGRSAECSIHLEVIVDRPLQVFHVDVEVKDINDNPPVFPATQKNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTLLVEVVDVNDNAPQLTIKTLSVPVKEDAQLGTVIALISVIDLDADANGQVTCSLTPHVPFKLVSTYKNYYSLVLDRALDRESVSAYELVVTARDGGSPSLWATARVSVEVADVNDNAPAFAQSEYTVFVKENNPPGCHIFTVSARDADAQENALVSYSLVERRLGERSLSSYVSVHAESGKVYALQPLDHEELELLQFQVSARDAGVPPLGSNVTLQVFVLDENDNAPALLTPRMRGTDGAVSEMVLRSVGAGVVVGKVRAVDADSGYNAWLSYELQPETASASIPFRVGLYTGEISTTRALDETDAPRQRLLVLVKDHGEPALTATATVLVSLVESGQAPKSSSRASVGATGPEVTLVDVNVYLIIAICAVSSLLVLTLLLYTVLRCSAMPTEGECAPGKPTLVCSSAVGSWSYSQQRRQRVCSGEGKQKTDLMAFSPGLSPCAGSTERTGEPSASSDSTGKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 60319 - protein, 963 aa, Homo sapiens
MVGCGVAVLCLWVSCGAAAGQLEYSVPEETERGVAVGNLSADLRLPAAAMSSRNFRFLSSHRELYFGVDLPSGNLVVREPADREQLCRAKAACVLTYDLVLEDPLELHKIRIHVLDTNDNSPLFPAGDVQLHIPEFLTPGARFTLPNAQDDDEGSNGILSYSLSPSQHFRLDMGSRVDGSEYPELVLEKALDREQRATHLLVLTARDGGLPARSGDAQVTIIVVDTNDNAPVFERSVYRTKVPETAPNGTVLFRVQALDPDEGSNGEVQYSLSNSTQAELRHRFHVHPKSGEVQVAASLGPPETLLEAYIEARDEGVFGLASTAKLLVEVTDVNDHAPELDFLTLSNPVPEDAAPGTVIALFSVKDEDLDSNGRVICGMSSAGPFQLTASFDNYYSLLIDGPLDREQISEYQVLITASDSGSPPLSTRRTITVSVADVNDNTPNFPQPQQELFVAENNGPGASLGRVFAQDPDLGKNGLVSYELLDVISEGPSASSLLAVESSSGAITAKTSFDFEQLRGFHFQVEGRDGGIPPRSATVTINLFVVDRNDNYPVILFPLPRNGSVPVEIVPRSARTGHLVTKVVAEDADSGSNAWLSYHISRASDSSLFRISANIGELRTARLVLPTDAVKQRVVVVVRDHGDPPLSSSVTLGVLLSNSVPQLLPDFEDVWEPGGQLSAQNLYLVIALACISFLFLGCLLFFVCTKLHQSPGCCAQSCCRSTEDLRYGSKMVSNPCMTSATIDVTTVERLSQTYLYRASLGLGSDNNSLLLRGEYNAADLRNLATGVGLNLPISCIQIRNRKGDHANVNAMPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 60320 - protein, 818 aa, Homo sapiens
MVGCGVAVLCLWVSCGAAAGQLEYSVPEETERGVAVGNLSADLRLPAAAMSSRNFRFLSSHRELYFGVDLPSGNLVVREPADREQLCRAKAACVLTYDLVLEDPLELHKIRIHVLDTNDNSPLFPAGDVQLHIPEFLTPGARFTLPNAQDDDEGSNGILSYSLSPSQHFRLDMGSRVDGSEYPELVLEKALDREQRATHLLVLTARDGGLPARSGDAQVTIIVVDTNDNAPVFERSVYRTKVPETAPNGTVLFRVQALDPDEGSNGEVQYSLSNSTQAELRHRFHVHPKSGEVQVAASLGPPETLLEAYIEARDEGVFGLASTAKLLVEVTDVNDHAPELDFLTLSNPVPEDAAPGTVIALFSVKDEDLDSNGRVICGMSSAGPFQLTASFDNYYSLLIDGPLDREQISEYQVLITASDSGSPPLSTRRTITVSVADVNDNTPNFPQPQQELFVAENNGPGASLGRVFAQDPDLGKNGLVSYELLDVISEGPSASSLLAVESSSGAITAKTSFDFEQLRGFHFQVEGRDGGIPPRSATVTINLFVVDRNDNYPVILFPLPRNGSVPVEIVPRSARTGHLVTKVVAEDADSGSNAWLSYHISRASDSSLFRISANIGELRTARLVLPTDAVKQRVVVVVRDHGDPPLSSSVTLGVLLSNSVPQLLPDFEDVWEPGGQLSAQNLYLVIALACISFLFLGCLLFFVCTKLHQSPGCCAQSCCRSTEDLRYGSKMVSNPCMTSATIDVTTVERLSQTYLYRASLGLGSDNNSLLLRGEYNAADLRNLATGVGLNLPISCIQIRNRKGDHANVNAMVSKFYGI

SEQ ID NO: 60321 - protein, 1007 aa, Homo sapiens
MEQAGTRPAATEHPRLRRPMPWLLLLPLLLLLLLLLPGPAASQLRYSVPEEQAPGALVGNVARALGLELRRLGPGCLRINHLGAPSPRYLELDLTSGALFVNERIDREALCEQRPRCLLSLEVLAHNPVAVSAVEVEILDINDNSPRFPRPNYQLQVSESVAPGARFHIESAQDPDVGANSVQTYELSPSEHFELDLKPLQENSKVLELVLRKGLDREQAALHHLVLTAVDGGIPARSGTAQISVRVLDTNDNSPAFDQSTYRVQLREDSPPGTLVVKLNASDPDEGSNGELRYSLSSYTSDRERQLFSIDASTGEVRVIGGLDYEEASSYQIYVQATDRGPVPMAGHCKVLVDIVDVNDNAPEVVLTDLYSPVPENATPNTIVAVLSVNDQDSGPNRKVSLGLEATLPFRLNGFGNSYTLVVSGPLDRERVAVYNITVTATDGGIPQLTSLRTLKVEISDINDNPPSFLEDSYSIYIQENNLPGVLLCTVQATDPDEKENAEVTYSLLEREIQGLPVTSYVSINSASGSLYAVNSFDYEKFREFFVTVEAQDKGSPPLSSTVTANVYVVDMNDHAPHILYPTSTNSSAAFEMVPRTAPAGYLVTKVIAMDSDSGQNAWLFYHLAQTSDLDLFKVELHTGEIRTTRKMGDESGSTFNLTVVVRDNGEPSLSASVAITVAVVDRVSKILPDTQRHVKSPRTYSEITLYLIIALSTVSFIFLLTIIILSIIKCYRYTAYGTACCGGFCGVRERSPAELYKQANNNIDARIPHGLKVQPHFIEVRGNGSLTKTYCYKACLTAGSGSDTFMFYNTGAQTGPGPSGAQAAVTDSRNLTGQSGQNAGNLIILKNEAVSQNEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 60322 - protein, 818 aa, Homo sapiens
MAGTRRKSLQNRQVGSLLIFLCISVGDATTIRYSVAEEMESGSFVANVAKDLGLEVGKLAARGARLVSEGNKMHFRLHRKTGDLFVKEKLDRESLCGKADPCVLHFEVVLVEPLQSFRAEVRVFDINDNAPVFLNKEPLLKIPESTPLGSRFPLQSAQDLDVGLNGLQNYTLSANGYFHLHTRFCSHGPKYAELVLNKPLDREEQPEVNLTITAVDGGSPPKSGTAHIHVVVLDVNDHVPQFSRLVYRAQVSENSPNGSLVATVTAVDLDEGTNKAITYSLAQNPEAILKTFQIDPQNGEVRLRGPLDFEAIETYDIDIQATDGGGLSAHSKVLVEVVDVNDNPPEVMVSSVSSPLPEDSPPQTVVALFTIRDRDIRVGGKVTCFLREDLPFVIKPTFGNSYSLVTDRSLDREEVSGYNITIVAMDTGPPSLSAETMIEVLISDVNDNPPIFREDSYILTVRENNSPAVFIGKVHAEDLDLGENAQITYSLLPPKNGDLSVFAYISINSGNGKLYALRTMDYEAIQDFQFVVKATDGGFLSLSSQVTVRVVVLDDNDNRPMILYPLQNGTLPCNDLVPRSAEAGYLVTKVVAVDGDSGQNSWLSYHLLKATDLGLFSVQRQNGEIHTLRQISERDPMMQKLIILVQDHGQPALSTTVSLNILLVDGFSEPYLQFQDPTKHSRKVNPSTKYLVISLVILSFLFLLSVIVIFIIHVYQKIKYREKFTIQEHFYDDCNFSNNLVQGQGNGSLSRPCPYEMCSATGTGNSEFRFLKRFMPNFPFPHATGEIKMEAGSSLPPNSDRNKSQRLEGHDQVSDDYM

SEQ ID NO: 60323 - protein, 797 aa, Homo sapiens
MENQGTRTQQIRQVLLLFVLLGMSQAGSETWSFSVAEEMQSGSFVGNLAKDLGLKVRELSSRGARVVSNDKKQRLQLDINTGDLLLSETLDREELCGSIEPCVLHLQVLMQNPTQFLQIELQVRDINDHSPIFSEKQMLLEIPENSPVGAVFLLESAKDLDVGINAVKSYTISPNSHFHIKMRVIPDNRKYPELVLDKALDYEELPELSFILSALDGGSPPRSGTALVRVVVVDINDNSPEFEQAFYEVKIRENSILGSLILIVSAWDLDSGTNGEICYTFSHASEDIRKTFEINQKSGEITLRAPLDFETIESYSIIIQATDGGGLFGKSTVIIHVIDVNDNAPEITVSSITSPIPENTPETVVMVFSIQDIDSGDNGRIVCSIPEDLPFVLKSSVENYYTLETERPLDRESTAEYNITITVTDLGIPRLKTEHNTTVLVSDVNDNAPTFTQTSYTLFVRENNSPALHIGSVSATDRDSGTNAQVNYSLLPPQDLHLPLASLVSINTDNGHLFALRSLDYEALQAFDFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLQVLLVDGFSQPYLPLPEAAPAQAQADSLTVYLVVALASVSSLFLFSVLLFVAVRLCRRSRAASVGSCSVPKGPFPGHLVDVSGTGTLSQSYQYEVCLTGGSETNEFKFLKPVIPNIQAKGLGKNSEENSTFRNSFGFNF

SEQ ID NO: 60324 - protein, 432 aa, Homo sapiens
MVFSIQDIDSGDNGRIVCSIPEDLPFVLKSSVENYYTLETERPLDRESTAEYNITITVTDLGIPRLKTEHNTTVLVSDVNDNAPTFTQTSYTLFVRENNSPALHIGSVSATDRDSGTNAQVNYSLLPPQDLHLPLASLVSINTDNGHLFALRSLDYEALQAFDFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLQVLLVDGFSQPYLPLPEAAPAQAQADSLTVYLVVALASVSSLFLFSVLLFVAVRLCRRSRAASVGSCSVPKGPFPGHLVDVSGTGTLSQSYQYEVCLTGGSETNEFKFLKPVIPNIQAKGLGKNSEENSTFRNSFGFNF

SEQ ID NO: 60325 - protein, 132 aa, Homo sapiens
TIESYSIIIQATDGGGLFGKSTVIIHVIDVNDNAPEITVSSITSPIPENTPETVVMVFSIQDIDGTTEELFVPFRKTSHVLKSSVENYYTLETERPLDRESTAEYNITITVTDLGIPRLKTEHNTTVLVSDV

SEQ ID NO: 60326 - protein, 795 aa, Homo sapiens
MENGGAGTLQIRQVLLFFVLLGMSQAGSETGNFLVMEELQSGSFVGNLAKTLGLEVSELSSRGARVVSNDNKECLQLDTNTGDLLLREMLDREELCGSNEPCVLYFQVLMKNPTQFLQIELQVRDINDHSPVFLEKEMLLEIPENSPVGAVFLLESAKDLDVGINAVKSYTINPNSHFHVKIRVNPDNRKYPELVLDKALDYEERPELSFILTALDGGSPPRSGTALVRVVVVDINDNSPEFEQAFYEVKILENSILGSLVVTVSAWDLDSGTNSELSYTFSHASEDIRKTFEINQKSGDITLTAPLDFEAIESYSIIIQATDGGGLFGKSTVRIQVMDVNDNAPEITVSSITSPIPENTPETVVMVFRIRDRDSGDNGKMVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAAPVGRCSVPEGPFPGHLVDVSGTGTLSQSYHYEVCVTGGSRSNKFKFLKPIIPNFLPQSTGSEVEENPPFQNNLGF

SEQ ID NO: 60327 - protein, 418 aa, Homo sapiens
MVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAAPVGRCSVPEGPFPGHLVDVSGTGTLSQSYHYEVCVTGGSRSNKFKFLKPIIPNFLPQSTGSEVEENPPFQNNLGFWIQ

SEQ ID NO: 60328 - protein, 458 aa, Homo sapiens
MDVNDNAPEITVSSITSPIPENTPETVVMVFRIRDRDSGDNGKMVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAAPVGRCSVPEGPFPGHLVDVSGTGTLSQSYHYEVCVTGGSRSNKFKFLKPIIPNFLPQSTGSEVEENPPFQNNLGF

SEQ ID NO: 60329 - protein, 798 aa, Homo sapiens
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPQDPHLPLTSLVSINADNGHLFALRSLDYEALQGFQFRVGASDHGSPALSSEALVRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYLVVALASVSSLFLFSVLLFVAVRLCRRSRAASVGRCLVPEGPLPGHLVDMSGTRTLSQSYQYEVCLAGGSGTNEFKFLKPIIPNFPPQCPGKEIQGNSTFPNNFGFNIQ

SEQ ID NO: 60330 - protein, 744 aa, Homo sapiens
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYLVVALASVSSLFLFSVLLFVAVRLCRRSRAASVGRCLVPEGPLPGHLVDMSGTRTLSQSYQYEVCLAGGSGTNEFKFLKPIIPNFPPQCPGKEIQGNSTFPNNFGFNIQ

SEQ ID NO: 60331 - protein, 802 aa, Homo sapiens
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPQDPHLPLTSLVSINADNGHLFALRSLDYEALQGFQFRVGASDHGSPALSSEALVRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYLVVALASVSSLFLFSVLLFVAVRLCRRSRAASVGRCLVPEGPLPGHLVDMSGTRTLSQSYQYEVCLAGGSGTNEFKFLKPIIPNFPPQCPGKEIQGNSTFPNLCVCNIVRIYS

SEQ ID NO: 60332 - protein, 798 aa, Homo sapiens
MEIRGALDLRKRQVLIFLVLLGLSRAGTESAHYSVAEETEIGSFVANLARDLGLGVEELSSREARVVSDDNKKYLHLDLLTGNLLLNEKLDRDELCGSTEPCVLHFQVVLENPLQFFRFELCVKDINDHSPTFLDKEILIKISEGTTVGATFLMESAQDLDVGSNSLQNYTISPNSHFYIKIPDSSDRKIYPELVLDRALDYEQEAELRLTLTAVDGGSPPKSGTTLVLIKVLDINDNAPEFPQSLYEVQVPEDRPLGSWIATISAKDLDAGNYGKISYTFFHASEDIRKTFEINPISGEVNLRSPLDFEVIQSYTINIQATDGGGLSGKCTLLVKVMDINDNPPEVTISSITKRIPENASETLVALFSILDQDSGDNGRMICSIQDNLPFFLKPTFKNFFTLVSEKALDRESQAEYNITITVTDLGTPRLKTEYNITVLLSDVNDNAPTFTQTSYTLFVRENNSPALHIGSVSATDRDSGTNAQVNYSLLPPQDRHLPLASLVSINADNGHLFALRSLDYEALQEFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYQYEVCLTGGSGTNEFKFLKPIIPNFQVHDTGRNMGEIENFRNSFGLNIQ

SEQ ID NO: 60333 - protein, 645 aa, Homo sapiens
MESAQDLDVGSNSLQNYTISPNSHFYIKIPDSSDRKIYPELVLDRALDYEQEAELRLTLTAVDGGSPPKSGTTLVLIKVLDINDNAPEFPQSLYEVQVPEDRPLGSWIATISAKDLDAGNYGKISYTFFHASEDIRKTFEINPISGEVNLRSPLDFEVIQSYTINIQATDGGGLSGKCTLLVKVMDINDNPPEVTISSITKRIPENASETLVALFSILDQDSGDNGRMICSIQDNLPFFLKPTFKNFFTLVSEKALDRESQAEYNITITVTDLGTPRLKTEYNITVLLSDVNDNAPTFTQTSYTLFVRENNSPALHIGSVSATDRDSGTNAQVNYSLLPPQDRHLPLASLVSINADNGHLFALRSLDYEALQEFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYQYEVCLTGGSGTNEFKFLKPIIPNFQVHDTGRNMGEIENFRNSFGLNIQ

SEQ ID NO: 60334 - protein, 787 aa, Homo sapiens
MEPAGERFPEQRQVLILLLLLEVTLAGWEPRRYSVMEETERGSFVANLANDLGLGVGELAERGARVVSEDNEQGLQLDLQTGQLILNEKLDREKLCGPTEPCIMHFQVLLKKPLEVFRAELLVTDINDHSPEFPEREMTLKIPETSSLGTVFPLKKARDLDVGSNNVQNYNISPNSHFHVSTRTRGDGRKYPELVLDTELDREEQAELRLTLTAVDGGSPPRSGTVQILILVLDANDNAPEFVQALYEVQVPENSPVGSLVVKVSARDLDTGTNGEISYSLYYSSQEIDKPFELSSLSGEIRLIKKLDFETMSSYDLDIEASDGGGLSGKCSVSVKVLDVNDNFPELSISSLTSPIPENSPETEVALFRIRDRDSGENGKMICSIQDDVPFKLKPSVENFYRLVTEGALDRETRAEYNITITITDLGTPRLKTEQSITVLVSDVNDNAPAFTQTSYTLFVRENNSPALHIGSVSATDRDSGTNAQVTYSLLPPRDPHLPLTSLVSINTDNGHLFALQSLDYEALQAFEFRVGATDRGFPALSSEALVRVLVLDANDNSPFVLYPLQNGSAPCTELVPRAAEPGYLVTKVVAVDGDSGQNAWLSYQLLKATEPGLFGVWAHNGEVRTARLLSERDVAKHRLVVLVKDNGEPPRSATATLQVLLVDGFSQPYLPLPEAAPAQAQADSLTVYLVVALASVSSLFLFSVFLFVAVRLCRRSRAASVGRCSVPEGPFPGHLVDVSGTGTLSQSYQYEVCLTGGSESNDFKFLKPIFPNIVSQDSRRKSEFLE

SEQ ID NO: 60335 - protein, 776 aa, Homo sapiens
MEIGWMHNRRQRQVLVFFVLLSLSGAGAELGSYSVVEETERGSFVANLGKDLGLGLTEMSTRKARIISQGNKQHLQLKAQTGDLLINEKLDREELCGPTEPCILHFQVLMENPLEIFQAELRVIDINDHSPMFTEKEMILKIPENSPLGTEFPLNHALDLDVGSNNVQNYKISPSSHFRVLIHEFRDGRKYPELVLDKELDREEEPQLRLTLTALDGGSPPRSGTAQVRIEVVDINDNAPEFEQPIYKVQIPENSPLGSLVATVSARDLDGGANGKISYTLFQPSEDISKTLEVNPMTGEVRLRKQVDFEMVTSYEVRIKATDGGGLSGKCTLLLQVVDVNDNPPQVTMSALTSPIPENSPEIVVAVFSVSDPDSGNNGKTISSIQEDLPFLLKPSVKNFYTLVTERALDREARAEYNITLTVTDMGTPRLKTEHNITVQISDVNDNAPTFTQTSYTLFVRENNSPALHIGSVSATDRDSGTNAQVTYSLLPPQDPHLPLASLVSINADNGHLFALRSLDYEALREFEFRVSATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPRSATATLHVLLVDGFSQPFLPLPEAAPGQTQANSLTVYLVVALASVSSLFLFSVLLFVAVRLCRRSRAASVGRCSMPEGPFPGRLVDVSGTGTLSQSYQYEVCLTGGSETSEFKFLKPIIPNFSP

SEQ ID NO: 60336 - protein, 798 aa, Homo sapiens
MEAGEGKERVPKQRQVLIFFVLLGIAQASCQPRHYSVAEETESGSFVANLLKDLGLEIGELAVRGARVVSKGKKMHLQFDRQTGDLLLNEKLDREELCGPTEPCVLPFQVLLENPLQFFQAELRIRDVNDHSPVFLDKEILLKIPESITPGTTFLIERAQDLDVGTNSLQNYTISPNFHFHLNLQDSLDGIILPQLVLNRALDREEQPEIRLTLTALDGGSPPRSGTALVRIEVVDINDNVPEFAKLLYEVQIPEDSPVGSQVAIVSARDLDIGTNGEISYAFSQASEDIRKTFRLSAKSGELLLRQKLDFESIQTYTVNIQATDGGGLSGTCVVFVQVMDLNDNPPELTMSTLINQIPENLQDTLIAVFSVSDPDSGDNGRMVCSIQDDLPFFLKPSVENFYTLVISTALDRETRSEYNITITVTDFGTPRLKTEHNITVLVSDVNDNAPAFTQTSYTLFVRENNSPALHIGSVSATDRDSGTNAQVTYSLLPPQDPHLPLASLVSINADNGHLFALQSLDYEALQAFEFRVGAADRGSPALSSEALVRVLVLDANDNSPFVLYPLQNGSAPCTELVPRAAEPGYLVTKVVAVDGDSGQNAWLSYQLLKATEPGLFGVWAHNGEVRTARLLRERDAAKQRLVVLVKDNGEPPRSATATLHVLLVDGFSQPYLLLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFT

SEQ ID NO: 60337 - protein, 796 aa, Homo sapiens
MEAGGERFLRQRQVLLLFVFLGGSLAGSESRRYSVAEEKEKGFLIANLAKDLGLRVEELAARGAQVVSKGNKQHFQLSHQTGDLLLNEKLDREELCGPTEPCILHFQILLQNPLQFVTNELRIIDVNDHSPVFFENEMHLKILESTLPGTVIPLGNAEDLDVGRNSLQNYTITPNSHFHVLTRSRRDGRKYPELVLDKALDREEQPELSLTLTALDGGSPPRSGTAQINIQVLDINDNAPEFAQPLYEVAVLENTPVNSVIVTVSASDLDTGSFGTISYAFFHASEEIRKTFQLNPITGDMQLVKYLNFEAINSYEVDIEAKDGGGLSGKSTVIVQVVDVNDNPPELTLSSVNSPIPENSGETVLAVFSVSDLDSGDNGRVMCSIENNLPFFLKPSVENFYTLVSEGALDRETRSEYNITITITDLGTPRLKTKYNITVLVSDVNDNAPAFTQISYTLFVRENNSPALHIGSVSATDRDSGTNAQVTYSLLPPQDPHLPLSSLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFS

SEQ ID NO: 60338 - protein, 795 aa, Homo sapiens
MKKLGRIHPNRQVLAFILMVFLSQVRLEPIRYSVLEETESGSFVAHLAKDLGLGIGELASRSARVLSDDDKQRLQLDRQTGDLLLREKLDREELCGPIEPCVLHFQVFLEMPVQFFQGELLIQDINDHSPIFPEREVLLKILENSQPGTLFPLLIAEDLDVGSNGLQKYTISPNSHFHILTRNHSEGKKYPDLVQDKPLDREEQPEFSLTLVALDGGSPPRSGTVMVRILIMDINDNAPEFVHTPYGVQVLENSPLDSPIVRVLARDIDAGNFGSVSYGLFQASDEIKQTFSINEVTGEILLKKKLDFEKIKSYHVEIEATDGGGLSGKGTVVIEVVDVNDNPPELIISSLTSSIPENAPETVVSIFRIRDRDSGENGKMICSIPDNLPFILKPTLKNFYTLVTERPLDRETSAEYNITIAVTDLGTPRLKTQQNITVQVSDVNDNAPAFTQTSYTLFVRENNSPALHIGSVSATDRDSGTNAQVTYSLLPPQDPHLPLASLVSINADNGHLFALRSLDYEALQAFEFRVGASDRGSPALSSEALVRVLVLDTNDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYQYEVCLTGDSGTGEFKFLKPIFPNLLVQDTGREVKENPKFRNSLVFS

SEQ ID NO: 60339 - protein, 795 aa, Homo sapiens
METALAKTPQKRQVMFLAILLLLWEAGSEAVRYSIPEETESGYSVANLAKDLGLGVGELATRGARMHYKGNKELLQLDIKTGNLLLYEKLDREVMCGATEPCILHFQLLLENPVQFFQTDLQLTDINDHAPEFPEKEMLLKIPESTQPGTVFPLKIAQDFDIGSNTVQNYTISPNSHFHVATHNRGDGRKYPELVLDKALDREERPELSLTLTALDGGAPPRSGTTTIRIVVLDNNDNAPEFLQSFYEVQVPENSPLNSLVVVVSARDLDAGAYGSVAYALFQGDEVTQPFVIDEKTAEIRLKRALDFEATPYYNVEIVATDGGGLSGKCTVAIEVVDVNDNAPELTMSTLSSPTPENAPETVVAVFSVSDPDSGDNGRMICSIQNDLPFLLKPTLKNFYTLVTQRTLDRESQAEYNITITVTDMGTPRLKTEHNITVLVSDVNDNAPAFTQTSYTLFVRENNSPALHIGSVSATDRDSGTNAQVTYSLLPPQNPHLRLASLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFSMWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYHYEVCLTGDSGAGEFKFLKPIIPNLLPQGAGEEIGKTAAFRNSFGLN

SEQ ID NO: 60340 - protein, 368 aa, Homo sapiens
GGAPPRSGTTTIRIVVLDNNDNAPEFLQSFYEVQVPENSPLNSLVVVVSARDLDAGAYGSVAYALFQGDEVTQPFVIDEKTAEIRLKRALDFEATPYYNVEIVATDGGGLSGKCTVAIEVVDVNDNAPELTMSTLSSPTPENAPETVVAVFSVSDPDSGDNGRMICSIQNDLPFLLKPTLKNFYTLVTQRTLDRESQAEYNITITVTDMGTPRLKTEHNITVLVSDVNDNAPAFTQTSYTLFVRENNSPALHIGSVSATDRDSGTNAQVTYSLLPPQNPHLRLASLVSINADNGHLFALRSLDYEALQAFEFRVGATDRGSPALSSEALVRVLCWTPTTTRPSCCIRCRTARRLAPSWCPGRPSRATW

SEQ ID NO: 60341 - protein, 794 aa, Homo sapiens
MMQTKVQNKKRQVAFFILLMLWGEVGSESIQYSVLEETESGTFVANLTKDLGLRVGELASRGARVVFKGNRQHLQFDPQTHDLLLNEKLDREELCGSTEPCVLPFQVLLENPLQFFQASLRVRDINDHAPEFPAREMLLKISEITMPGKIFPLKMAHDLDTGSNGLQRYTISSNPHFHVLTRNRSEGRKFPELVLDKPLDREEQPQLRLTLIALDGGSPPRSGTSEIQIQVLDINDNVPEFAQELYEAQVPENNPLGSLVITVSARDLDAGSFGKVSYALFQVDDVNQPFEINAITGEIRLRKALDFEEIQSYDVDVEATDGGGLSGKCSLVVRVLDVNDNAPELTMSFFISLIPENLPEITVAVFSVSDADSGHNQQVICSIENNLPFLLRPSVENFYTLVTEGALDRESRAEYNITITVTDLGTPRLKTQQSITVQVSDVNDNVPAFTQTSYTLFVRENNSPALHIGSVSATDRDSGINAQVTYSLLPPQDPHLPLSSLVSINADNGHLFALRSLDYEALQSFEFRVGATDRGSPALSSEALVRLLVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRYSVPEGPFPGHLVDVSGTGTLSQSYQYKVCLTGGSETNEFKFLKPIMPNFPPQGTEREMEETPTSRNSFPFS

SEQ ID NO: 60342 - protein, 368 aa, Homo sapiens
GGSPPRSGTSEIQIQVLDINDNVPEFAQELYEAQVPENNPLGSLVITVSARDLDAGSFGKVSYALFQVDDVNQPFEINAITGEIRLRKALDFEEIQSYDVDVEATDGGGLSGKCSLVVRVLDVNDNAPELTMSFFISLIPENLPEITVAVFSVSDADSGHNQQVICSIENNLPFLLRPSVENFYTLVTEGALDRESRAEYNITITVTDLGTPRLKTQQSITVQVSDVNDNVPAFTQTSYTLFVRENNSPALHIGSVSATDRDSGINAQVTYSLLPPQDPHLPLSSLVSINADNGHLFALRSLDYEALQSFEFRVGATDRGSPALSSEALVRLLCWTPTTTRPSCCTRCRTAPRPAPSWCPGRPSRATW

SEQ ID NO: 60343 - protein, 658 aa, Homo sapiens
MLLKISEITMPGKIFPLKMAHDLDTGSNGLQRYTISSNPHFHVLTRNRSEGRKFPELVLDKPLDREEQPQLRLTLIALDGGSPPRSGTSEIQIQVLDINDNVPEFAQELYEAQVPENNPLGSLVITVSARDLDAGSFGKVSYALFQVDDVNQPFEINAITGEIRLRKALDFEEIQSYDVDVEATDGGGLSGKCSLVVRVLDVNDNAPELTMSFFISLIPENLPEITVAVFSVSDADSGHNQQVICSIENNLPFLLRPSVENFYTLVTEGALDRESRAEYNITITVTDLGTPRLKTQQSITVQVSDVNDNVPAFTQTSYTLFVRENNSPALHIGSVSATDRDSGINAQVTYSLLPPQDPHLPLSSLVSINADNGHLFALRSLDYEALQSFEFRVGATDRGSPALSSEALVRLLVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRYSVPEGPFPGHLVDVSGTGTLSQSYQYKVCLTGGSETNEFKFLKPIMPNFPPQGTEREMEETPTSRNSFPFS

SEQ ID NO: 60344 - protein, 793 aa, Homo sapiens
MEARVERAVQKRQVLFLCVFLGMSWAGAEPLRYFVAEETERGTFLTNLAKDLGLGVGELRARGTRIVSDQNMQILLLSSLTGDLLLNEKLDREELCGPREPCVLPFQLLLEKPFQIFRAELWVRDINDHAPVFLDREISLKILESTTPGAAFLLESAQDSDVGTNSLSNYTISPNAYFHINVHDSGEGNIYPELVLNQVLDREEIPEFSLTLTALDGGSPPRSGTALVRILVLDVNDNAPDFVRSLYKVQVPENSPVGSMVVSVSARDLDTGSNGEIAYAFSYATERILKTFQINPTSGSLHLKAQLDYEAIQTYTLTIQAKDGGGLSGKCTVVVDVTDINDNRPELLLSSLTSPIAENSPETVVAVFRIRDRDSGNNGKTVCSIQDDVPFILKPSVENFYTLVTEKPLDRERNTEYNITITVTDLGTPRLKTEHNITVLVSDVNDNAPAFTQTSYTLFVRENNSPALPIGSVSATDRDSGTNAQVIYSLLPSQDPHLPLASLVSINADNGHLFALRSLDYEALQAFEFRVGATDRGSPALSSEALVRVLVLDANDNSPFVLYPLQNSSAPCTEPLPRAAEPGYLVTKVVAVDGDSGQNAWLSYQLLKATEPGLFGVWAHNGEVRTARLLSERDAAKQRLVVLVKDNGEPPRSATATLHVLLVDGFSQPYLRLPEAAPDQANSLTVYLVVALASVSSLFLLSVLLFVAVRLCRRSRAAPVGRCSVPEGPFPRHLVDLSGTGTLSQSYQYEVCLTGGSGTNEFKFLKPIIPNLLPQSTGREVEENRPFQNNLGF

SEQ ID NO: 60345 - protein, 368 aa, Homo sapiens
GSPPRSGTALVRILVLDVNDNAPDFVRSLYKVQVPENSPVGSMVVSVSARDLDTGSNGEIAYAFSYATERILKTFQINPTSGSLHLKAQLDYEAIQTYTLTIQAKDGGGLSGKCTVVVDVTDINDNRPELLLSSLTSPIAENSPETVVAVFRIRDRDSGNNGKTVCSIQDDVPFILKPSVENFYTLVTEKPLDRERNTEYNITITVTDLGTPRLKTEHNITVLVSDVNDNAPAFTQTSYTLFVRENNSPALPIGSVSATDRDSGTNAQVIYSLLPSQDPHLPLASLVSINADNGHLFALRSLDYEALQAFEFRVGATDRGSPALSSEALVRVLCWTPTTTRPSCCTRCRTAPRPAPSRCPGRPSRATW

SEQ ID NO: 60346 - protein, 801 aa, Homo sapiens
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTAFPLKNAEDLDIGQNNIENYIISPNSYFRVLTRKRSDGRKYPELVLDKALDREEEAELRLTLTALDGGSPPRSGTAQVYIEVVDVNDNAPEFEQPFYRVQISEDSPISFLVVKVSATDVDTGVNGEISYSLFQASDEISKTFKVDFLTGEIRLKKQLDFEKFQSYEVNIEARDAGGFSGKCTVLIQVIDVNDHAPEVTMSAFTSPIPENAPETVVALFSVSDLDSGENGKISCSIQEDLPFLLKSSVGNFYTLLTETPLDRESRAEYNVTITVTDLGTPRLTTHLNMTVLVSDVNDNAPAFTQTSYTLFVRENNSPALHIGSVSATDRDSGTNAQVTYSLLPPQDPHLPLASLVSINTDNGHLFALRSLDYEALQAFEFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPCSATATLHLLLVDGFSQPYLPLPEAAPAQGQADSLTVYLVVALASVSSLFLFSVLLFVAVLLCRRSRAASVGRCSVPEGPFPGHLVDVRGTGSLSQNYQYEVCLAGGSGTNEFQFLKPVLPNIQGHSFGPEMEQNSNFRNGFGFSLQLK

SEQ ID NO: 60347 - protein, 823 aa, Homo sapiens
MKIQKKLTGCSRLMLLCLSLELLLEAGAGNIHYSVPEETDKGSFVGNIAKDLGLQPQELADGGVRIVSRGRMPLFALNPRSGSLITARRIDREELCAQSMPCLVSFNILVEDKMKLFPVEVEIIDINDNTPQFQLEELEFKMNEITTPGTRVSLPFGQDLDVGMNSLQSYQLSSNPHFSLDVQQGADGPQHPEMVLQSPLDREEEAVHHLILTASDGGEPVRSGTLRIYIQVVDANDNPPAFTQAQYHINVPENVPLGTQLLMVNATDPDEGANGEVTYSFHNVDHRVAQIFRLDSYTGEISNKEPLDFEEYKMYSMEVQAQDGAGLMAKVKVLIKVLDVNDNAPEVTITSVTTAVPENFPPGTIIALISVHDQDSGDNGYTTCFIPGNLPFKLEKLVDNYYRLVTERTLDRELISGYNITITAIDQGTPALSTETHISLLVTDINDNSPVFHQDSYSAYIPENNPRGASIFSVRAHDLDSNENAQITYSLIEDTIQGAPLSAYLSINSDTGVLYALRSFDYEQFRDMQLKVMARDSGDPPLSSNVSLSLFLLDQNDNAPEILYPALPTDGSTGVELAPLSAEPGYLVTKVVAVDRDSGQNAWLSYRLLKASEPGLFSVGLHTGEVRTARALLDRDALKQSLVVAVQDHGQPPLSATVTLTVAVADRISDILADLGSLEPSAKPNDSDLTLYLVVAAAAVSCVFLAFVIVLLAHRLRRWHKSRLLQASGGGLASMPGSHFVGVDGVRAFLQTYSHEVSLTADSRKSHLIFPQPNYADTLISQESCEKKGFLSAPQSLLEDKKEPFSQVNFCDECISYLEKNNS

SEQ ID NO: 60348 - protein, 931 aa, Homo sapiens
MKIQKKLTGCSRLMLLCLSLELLLEAGAGNIHYSVPEETDKGSFVGNIAKDLGLQPQELADGGVRIVSRGRMPLFALNPRSGSLITARRIDREELCAQSMPCLVSFNILVEDKMKLFPVEVEIIDINDNTPQFQLEELEFKMNEITTPGTRVSLPFGQDLDVGMNSLQSYQLSSNPHFSLDVQQGADGPQHPEMVLQSPLDREEEAVHHLILTASDGGEPVRSGTLRIYIQVVDANDNPPAFTQAQYHINVPENVPLGTQLLMVNATDPDEGANGEVTYSFHNVDHRVAQIFRLDSYTGEISNKEPLDFEEYKMYSMEVQAQDGAGLMAKVKVLIKVLDVNDNAPEVTITSVTTAVPENFPPGTIIALISVHDQDSGDNGYTTCFIPGNLPFKLEKLVDNYYRLVTERTLDRELISGYNITITAIDQGTPALSTETHISLLVTDINDNSPVFHQDSYSAYIPENNPRGASIFSVRAHDLDSNENAQITYSLIEDTIQGAPLSAYLSINSDTGVLYALRSFDYEQFRDMQLKVMARDSGDPPLSSNVSLSLFLLDQNDNAPEILYPALPTDGSTGVELAPLSAEPGYLVTKVVAVDRDSGQNAWLSYRLLKASEPGLFSVGLHTGEVRTARALLDRDALKQSLVVAVQDHGQPPLSATVTLTVAVADRISDILADLGSLEPSAKPNDSDLTLYLVVAAAAVSCVFLAFVIVLLAHRLRRWHKSRLLQASGGGLASMPGSHFVGVDGVRAFLQTYSHEVSLTADSRKSHLIFPQPNYADTLISQESCEKKGFLSAPQSLLEDKKEPFSQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60349 - protein, 936 aa, Homo sapiens
MAAQRNRSKESKDCSGLVLLCLFFGIPWEAGARQISYSIPEELEKGSFVGNISKDLGLAPRELAERGVRIVSRGRTQLFSLNPRSGSLITAGRIDREELCAQSARCVVSFNILVEDRVKLFGIEIEVTDINDNAPKFQAENLDVKINENVAAGMRFPLPEAIDPDVGVNSLQSYQLSPNKHFSLRVQSRANGVKYPELVLEHSLDREEEAIHHLVLTASDGGDPLRSGTVLVSVTVFDANDNAPVFTLPEYRVSVPENLPVGTQLLTVTATDRDEGANGEVTYSFRKLPDTQLLKFQLNKYTGEIKISENLDYEETGFYEIEIQAEDGGAYLATAKVLITVEDVNDNSPELTITSLFSPVTEDSPLGTVVALLNVHDLDSEQNGQVTCSILAYLPFKLEKSIDSYYRLVIHRALDREQVSSYNITVTATDGGSPPLSTEAHFMLQVADINDNPPTFSQVSYFTYIPENNARGASIFSVTALDPDSKENAQIIYSLAEDTIQGVPLSSYISINSDTGVLYALRSFDYEQFHELQMQVTASDSGDPPLSSNVSLSLFVLDQNDNAPEILYPALPTDGSTGVELAPRSAEPGYLVTKVVAVDRDSGQNAWLSYRLLKASEPGLFAVGEHTGEVRTARALLDRDALKQSLVVAVQDHGQPPLSATVTLTVAVADSIPQVLADLGSFESPANSETSDLTLYLVVAVAAVSCVFLAFVIVLLAHRLRRWHKSRLLQASGGGLTGVSGSHFVGVDGVRAFLQTYSHEVSLTADSRKSHLIFPQPNYADTLISQESCEKNDPLSLLDDSKFPIEDTPLVPQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60350 - protein, 935 aa, Homo sapiens
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEVRTARALLDRDALKQSLVVAVQDHGQPPLSATVTLTVAVADSIPEVLADLGSLESLANSETSDLSLYLVVAVAAVSCIFLVFVIVLLALRLWRWHKSRLLQASEGGLAGMPTSHFVGVDGVQAFLQTYSHEVSLIADSQKSHLIFPQPNYGDTLISQESCEKSEPLLIAEDSAIILGKCDPTSNQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60351 - protein, 750 aa, Homo sapiens
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60352 - protein, 932 aa, Homo sapiens
MIPARLHRDYKGLVLLGILLGTLWETGCTQIRYSVPEELEKGSRVGDISRDLGLEPRELAERGVRIIPRGRTQLFALNPRSGSLVTAGRIDREELCMGAIKCQLNLDILMEDKVKIYGVEVEVRDINDNAPYFRESELEIKISENAATEMRFPLPHAWDPDIGKNSLQSYELSPNTHFSLIVQNGADGSKYPELVLKRALDREEKAAHHLVLTASDGGDPVRTGTARIRVMVLDANDNAPAFAQPEYRASVPENLALGTQLLVVNATDPDEGVNAEVRYSFRYVDDKAAQVFKLDCNSGTISTIGELDHEESGFYQMEVQAMDNAGYSARAKVLITVLDVNDNAPEVVLTSLASSVPENSPRGTLIALLNVNDQDSEENGQVICFIQGNLPFKLEKSYGNYYSLVTDIVLDREQVPSYNITVTATDRGTPPLSTETHISLNVADTNDNPPVFPQASYSAYIPENNPRGVSLVSVTAHDPDCEENAQITYSLAENTIQGASLSSYVSINSDTGVLYALSSFDYEQFRDLQVKVMARDNGHPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADSIPQVLADLGSLESPANSETSDLTLYLVVAVAAVSCVFLAFVILLLALRLRRWHKSRLLQASGGGLTGAPASHFVGVDGVQAFLQTYSHEVSLTTDSRKSHLIFPQPNYADMLVSQESFEKSEPLLLSGDSVFSKDSHGLIEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60353 - protein, 932 aa, Homo sapiens
MAALQKLPHCRKLVLLCFLLATLWEARAGQIRYSVREEIDRGSFVGNIAKDLGLEPLALAEQGVRIVSRGRSQLFALNPRSGSLVTANRIDREELCAQSAPCLLNFNILLEDKLTIYSVEVEITDINDNAPRFGVEELELKISETTTPGFRIPLKNAHDADVGENALQKYALNPNDHFSLDVRRGADGNKYPELVLERSLDREEEAVHHLVLVASDGGDPVLSGTSRICVKVLDANDNAPVFTQPEYRISIPENTLVGTRILTVTATDADEGYYAQVVYFLEKSPGETSEVFELKSTSGELTIIKDLDYEDATFHEIDIEAQDGPGLLTRAKVIVTVLDVNDNAPEFYMTSATSSVSEDSLPGTIIGLFNVHDRDSGQNAFTTCSLPEDLPFKLEKSVDNYYRLVTTRALDREQFSFYNITLTAKDGGNPSLSTDAHILLQVADINDNAPAFSRTSYSTYIPENNPRGASVFSVTAHDPDSNDNAHVTYSFAEDTVQGAPLSSYISINSDTGVLYALRSFDYEQLRDLQVWVIARDSGNPPLSSNVSLSLFVLDQNDNAPEILYPAFPTDGSTGVELAPRSAEPGYLVTKVVAVDRDSGQNAWLSYHLLKASEPGLFSVGLHTGEVRTARALLDRDALKQSLVVAIQDHGQPPLSATVTLTVAVADRIPDILADLGSLEPSAIPNDSDLTLYLVVAVAAVSCVFLAFVIVLLAHRLRRWHKSRLLQASGGSLTGMQSSHFVGVDGVRAFLQTYSHEVSLTADSRKSHLIFPQPNYADTLISQESCEKKDFLSAPQSLLEEEREETFSQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60354 - protein, 932 aa, Homo sapiens
MTNCLSFRNGRGLALLCALLGTLCETGSGQIRYSVSEELDKGSFVGNIANDLGLEPRELAERGVRIVSRGRTQLFSLNPQSGSLVTAERIDREELCAQIPLCLVKINILVEDKLKIFEVEIEIKDINDNAPNFPTEELEIKIGELTVPGTRFPIKTAFDPDVGINSLQNYKLSPNDYFSLAVNSVSEGAKYPELVLERALDREKKEIHQLVLVASDGGDPVHSGNLHIQVIVLDANDNPPMFTQPEYRVSVWENVPVGTRLLTVNATDPDEGFNAQVSYILDKMPGKIAEIFHLNSVSGEVSILKSLDYEDAMFYEIKIEAQDGPGLLSRAKILVTVLDVNDNAPEITITSLTSSVPEEGTVGREIALIDVHDRDSGQNGQVEVFVLGNLPFKLEKSIDQYYRLVTATSLDREQISEYNISLRASDGGSPPLSTETHITLHVIDINDNPPTFPHLSYSAYIPENNPRGASIFSVTAQDPDSNNNARITYALTEDTLQGAPLSSFVSINSNTGVLYALRSFDYEQFRDLKLLVTASDSGNPPLSSNVSLNLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLRRWHKSRLLQASGGGLASTPGSHFVGADGVRAFLQTYSHEVSLTADSRKSHLIFPQPNYADTLISQESCEKSEPLLITQDLLEMKGDSNLLQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60355 - protein, 931 aa, Homo sapiens
MASPPRGWGCGELLLPFMLLGTLCEPGSGQIRYSMPEELDKGSFVGNIAKDLGLEPQELAERGVRIVSRGRTQLFALNPRSGSLVTAGRIDREELCAQSPLCVVNFNILVENKMKIYGVEVEIIDINDNFPRFRDEELKVKVNENAAAGTRLVLPFARDADVGVNSLRSYQLSSNLHFSLDVVSGTDGQKYPELVLEQPLDREKETVHDLLLTALDGGDPVLSGTTHIRVTVLDANDNAPLFTPSEYSVSVPENIPVGTRLLMLTATDPDEGINGKLTYSFRNEEEKISETFQLDSNLGEISTLQSLDYEESRFYLMEVVAQDGGALVASAKVVVTVQDVNDNAPEVILTSLTSSISEDCLPGTVIALFSVHDGDSGENGEIACSIPRNLPFKLEKSVDNYYHLLTTRDLDREETSDYNITLTVMDHGTPPLSTESHIPLKVADVNDNPPNFPQASYSTSVTENNPRGVSIFSVTAHDPDSGDNARVTYSLAEDTFQGAPLSSYVSINSDTGVLYALRSFDYEQLRDLQLWVTASDSGNPPLSSNVSLSLFVLDQNDNTPEILYPALPTDGSTGVELAPRSAEPGYLVTKVVAVDKDSGQNAWLSYRLLKASEPGLFAVGLHTGEVRTARALLDRDALKQSLVVAVEDHGQPPLSATFTVTVAVADRIPDILADLGSIKTPIDPEDLDLTLYLVVAVAAVSCVFLAFVIVLLVLRLRRWHKSRLLQAEGSRLAGVPASHFVGVDGVRAFLQTYSHEVSLTADSRKSHLIFPQPNYADTLLSEESCEKSEPLLMSDKVDANKEERRVQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60356 - protein, 932 aa, Homo sapiens
MAPPQRHPQRSEQVLLLTLLGTLWGAAAAQIRYSIPEELEKGSFVGNIVKDLGLEPQELAEHGVRIVSRGRMQLFSLNPRNGSLVTAGRIDREELCAQSPRCLVSFNILVEDKLNLYPVEVEIVDINDNTPRFLKEELEVKILENAAPSSRFPLMEVYDPDVGMNSLQGFKLSGNSHFSVDVQSEAHGPKYPELVLEGTLDREGEAVYRLVLTAMDGGDPVRSSVAQILVTVLDVNDNTPMFTQPVYRVSVPENLPVGTPVLAVTATDQDEGVHGEVTYSFVKITEKISQIFCLNVLTGEISTSANLDYEDSSFYELGVEARDGPGLRDRAKVLITILDVNDNVPEVVVTSGSRTIAESAPPGTVIALFQVFDRDSGLNGLVTCSIPRSLPFELEKSVGNYYRLVTNAALDREEVFLYNITVTATDKGTPPLSTETIISLNVADTNDNPPTFPHSSYSVYVLENNPRGASIFSVNALDPDVDQNAQVSYSLAEDTLQGAPLSSYVSINSDTGILYALRSFDYEQLRDLQLWVTASDSGDPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLQRWHKSRLLQASGGGLASMPGSHFVGVEGVRAFLQTYSHEVSLTADSRKSHLIFPQPNYADTLINQESYEKSEPLLITQDLLETKGEPRQLQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60357 - protein, 932 aa, Homo sapiens
MAAQPRGGDYRGFFLLSILLGTPWEAWAGRILYSVSEETDKGSFVGDIAKDLGLEPRELAERGVRIISRGRTQLFALNQRSGSLVTAGRIDREEICAQSARCLVNFNILMEDKMNLYPIDVEIIDINDNVPRFLTEEINVKIMENTAPGVRFPLSEAGDPDVGTNSLQSYQLSPNRHFSLAVQSGDDETKYPELVLERVLDREEERVHHLVLTASDGGDPPRSSTAHIQVTVVDVNDHTPVFSLPQYQVTVPENVPVGTRLLTVHAIDLDEGVNGEVTYSFRKITPKLPKMFHLNSLTGEISTLEGLDYEETAFYEMEVQAQDGPGSLTKAKVLITVLDVNDNAPEVTMTSLSSSIPEDTPLGTVIALFYLQDRDSGKNGEVTCTIPENLPFKLEKSIDNYYRLVTTKNLDRETLSLYNITLKATDGGTPPLSRETHIFMQVADTNDNPPTFPHSSYSVYIAENNPRGASIFLVTAQDHDSEDNAQITYSLAEDTIQGAPVSSYVSINSDTGVLYALQSFDYEQLRELQLRVTAHDSGDPPLSSNMSLSLFVLDQNDNPPEILYPALPTDGSTGMELAPRSAEPGYLVTKVVAVDKDSGQNAWLSYLLLKASEPGLFAVGLYTGEVRTARALLDRDALKQSLVVAVQDHGQPPLSATVTLTVAVADSIPEVLADLGSLEPSDGPYNYDLTLYLVVAVATVSCVFLAFVLVLLALRLRRWHKSRLLQASEGGLANVPTSHFVGMDGVQAFLQTYSHEVSLTADSRKSHLIFPQPNYVDMLISQESCEKNDSLLTSVDFQECKENLPSIQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60358 - protein, 932 aa, Homo sapiens
MAAPQSRPRRGELILLCALLGTLWEIGRGQIRYSVPEETDKGSFVGNISKDLGLDPRKLAKHGVRIVSRGRTQLFALNPRSGSLITAGRIDREELCAQSPRCLININTLVEDKGKLFGVEIEIIDINDNNPKFQVEDLEVKINEIAVPGARYPLPEAVDPDVGVNSLQSYQLSPNHHFSLDVQTGDNGAINPELVLERALDREEEAAHHLVLTASDGGKPPRSSTVRIHVTVLDTNDNAPVFPHPIYRVKVLENMPPGTRLLTVTASDPDEGINGKVAYKFRKINEKQTPLFQLNENTGEISIAKSLDYEECSFYEMEIQAEDVGALLGRTKLLISVEDVNDNRPEVIITSLFSPVLENSLPGTVIAFLSVHDQDSGKNGQVVCYTRDNLPFKLEKSIGNYYRLVTRKYLDRENVSIYNITVMASDLGTPPLSTETQIALHVADINDNPPTFPHASYSAYILENNLRGASIFSLTAHDPDSQENAQVTYSVTEDTLQGAPLSSYISINSDTGVLYALQSFDYEQIRDLQLLVTASDSGDPPLSSNMSLSLFVLDQNDNAPEILYPALPTDGSTGVELAPRSAERGYLVTKVVAVDRDSGQNAWLSYRLLKASEPGLFSVGLHTGEVRTARALLDRDALKQSLVVAVQDHGQPPLSATVTLTVAVADSIPEVLTELGSLKPSVDPNDSSLTLYLVVAVAAISCVFLAFVAVLLGLRLRRWHKSRLLQDSGGRLVGVPASHFVGVEEVQAFLQTYSQEVSLTADSRKSHLIFPQPNYADMLISQEGCEKNDSLLTSVDFHEYKNEADHGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60359 - protein, 927 aa, Homo sapiens
MQRAREAEMMKSQVLFPFLLSLFCGAISQQIRYTIPEELANGSRVGKLAKDLGLSVRELPTRKLRVSAEDYFNVSLESGDLLVNGRIDREKICGRKLECALEFETVAENPMNVFHVVVVIQDINDNAPRFVAKGIDLEICESALPGVKFSLDSAQDADVEGNSLKLYTINPNQYFSLSTKESPDGSKYPVLLLEKPLDREHQSSHRLILTAMDGGDPPLSGTTHIWIRVTDANDNAPVFSQEVYRVSLQENVPWGTSVLRVMATDQDEGINAEITYAFLNSPISTSLFNLNPNTGDITTNGTLDFEETSRYVLSVEAKDGGVHTAHCNVQIEIVDENDNAPEVTFMSFSNQIPEDSDLGTVIALIKVRDKDSGQNGMVTCYTQEEVPFKLESTSKNYYKLVIAGALNREQTADYNVTIIATDKGKPALSSRTSITLHISDINDNAPVFHQASYVVHVSENNPPGASIAQVSASDPDLGPNGRVSYSILASDLEPRELLSYVSVSPQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRPEPSDPQTELQFYLVVALALISVLFLLAVILAIALRLRRSSSLDTEGCFQTGLCSKSGPGVPPNHSEGTLPYSYNLCIASHSAKTEFNSLNLTPEMAPPQDLLCDDPSMVVCASNEDHKIAYDPSLSSHQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60360 - protein, 931 aa, Homo sapiens
MKASSGRCGLVRWLQVLLPFLLSLFPGALPVQIRYSIPEELAKNSVVGNLAKDLGLSVRDLPARKLRVSAEKEYFTVNPESGDLLVSDRIDREQICGKQPLCVLDFDTVAENPLNIFYIAVIVQDINDNTPLFKQTKINLKIGESTKPGTTFPLDPALDSDVGPNSLQRYHLNDNEYFDLAEKQTPDGRKYPELILKHSLDREEHSLHQLVLTAVDGGDPPQSGTTQIRIKVTDANDNPPVFSQDVYRVTLREDVPPGFFVLQVTATDRDEGINAEITYSFHNVDEQVKHFFNLNEKTGEITTKDDLDFEIASSYTLSIEAKDPGDLAAHCSIQVEILDDNDCAPEVIVTSVSTPLPEDSPPGTVIALIKTRDRDSGENGEVYCQVLGNAKFILKSSSKNYYKLVTDGALDREEIPEYNLTITATDGGKPPLSSSIIVTLHISDVNDNAPVFQQTSYMVHVAENNPPGASIAQISASDPDLGPSGQVSYSIVASDLKPREILSYVSVSAQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRREPSDPQAKLQFYLVVALALISVLFFLAVILAISLRLRLSSRSDAWDCFQPGLSSKPGPGVLPNYSEGTLPYSYNLCVASQSAKTEFNFLNITPELVPAQDLVCDNASWEQNTNHGAAGVPFASDTILKQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60361 - protein, 923 aa, Homo sapiens
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILGSAHDADIGSNTLQNYQLSPSDHFSLINKEKSDGSKYPEMVLKTPLDREKQKSYHLTLTALDFGAPPLSSTAQIHVLVTDANDNAPVFSQDVYRVSLSENVYPGTTVLQVTATDQDEGVNAEITFSFSEASQITQFDLNSNTGEITVLNTLDFEEVKEYSIVLEARDGGGMIAQCTVEVEVIDENDNAPEVIFQSLPNLIMEDAELGTHIALLKVRDKDSRHNGEVTCKLEGDVPFKILTSSRNTYKLVTDAVLDREQNPEYNITVTATDRGKPPLSSSSSITLHIGDVNDNAPVFSQSSYIVHVAENNPPGASISQVRASDPDLGPNGQVSYCIMASDLEQRELSSYVSISAESGVVFAQRAFDHEQLRAFELTLQARDQGSPALSANVSLRVLVDDRNDNAPRVLYPALGPDGSALFDMVPHAAEPGYLVTKVVAVDADSGHNAWLSYHVLQASEPGLFSLGLRTGEVRTARALGDRDAVRQRLLVAVRDGGQPPLSATATLHLVFADSLQEVLPDITDRPDPSDLQAELQFYLVVALALISVLFLVAMILAIALRLRRSSSPASWSCFQPGLCVKSESVVPPNYSEGTLPYSYNLCVAHTGKTEFNFLKCSEQLSSGQDILCGDSSGALFPLCNSSELTSHQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60362 - protein, 930 aa, Homo sapiens
MGGSCAQRRRAGPRQVLFPLLLPLFYPTLSEPIRYSIPEELAKGSVVGNLAKDLGLSVLDVSARKLRVSAEKLHFSVDAESGDLLVKNRIDREQICKERRRCELQLEAVVENPLNIFHVIVVIEDVNDHAPQFDKKEIHLEIFESASAGTRLSLDPATDPDININSIKDYKINSNPYFSLMVRVNSDGGKYPELSLEKLLDREEQRSHSLILTALDGGDPPRSATAHIEISVKDTNDNPPVFSRDEYRISLSENLPPGSPVLQVTATDQDEGVNAEINYYFRSTAQSTKHMFSLDEKTGMIKNNQSFDFEDVERYTMEVEAKDGGGLSTQCKVIIEILDENDNSPEIIITSLSDQILENSPPGMVVALFKTRDLDFGGNGEVRCNIETDIPFKIYSSSNNYYKLVTDGALDREQTPEYNVTIVATDRGKPPLSSSRSITLYVADINDNAPVFDQTSYVVHVAENNPPGASIAQVSASDPDLGLNGHISYSIVASDLEPLAVSSYVSVSAQSGVVFAQRAFDHEQLRAFALTLQARDHGSPTLSANVSLRVLVGDRNDNAPRVLYPALGPDGSAFFDMVPRSAEPGYLVTKVVAVDADSGHNAWLSYHVLQASEPGLFSLGLRTGEVRTARALGDRDAARQRLLVAVRDGGQPPLSATATLHLVFADNLQEILPDLSDRPVLSDPQAELQFYLVVALALISVLFLLAVILAIALRLRRSLSPATWDCFHPGLCVKSGPVVPPNYSEGTLPYSYNLCIAHTGTKEFNFLKCSVPLHSNEDMVCSVSPGALIPPHGGEDLTSHPETLTSQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60363 - protein, 929 aa, Homo sapiens
MGGSCAQRRRAGPRQVLFPLLLPLFYPTLCEPIRYSIPEELAKGSVVGNLAKDLGLSVLDVSARELRVSAEKLHFSVDAQSGDLLVKDRIDREQICKERRRCELQLEAVVENPLNIFHVIVVIEDVNDHAPQFRKDEINLEISESVSLGMGTILESAEDPDISMNSLSKYQLSPNEYFSLVEKDNPDGGKYPELVLQKTLDRETQSAHHLVLTALDGGDPPRSGTAQIRILVIDANDNPPVFSQDVYRVSLREDVPPGTSILRVKATDQDEGINSEITYSFFGVADKAQHVFSLDYTTGNILTQQPLDFEEVERYTINIEAKDRGSLSTRCKVIVEVVDENDNSPEIIITSLSDQIMEDSPPGVVVALFKTRDQDSGENGEVRCSLSRGVPFKIHSSSNNYYKLVTDEALDREQTPEYNVTIAATDRGKPPLSSSKTITLHITDVNDNAPVFGQSAYLVHVPENNQPGASIAQVSASDPDFGLNGRVSYSLIASDLESRTLSSYVSVSAQSGVVFAQRAFDHEQLRTFELTLQARDQGSPALSANVSLRVLVGDRNDNAPRVLYPALGPDGSALFDTVPRAAQPGYLVTKVVAVDADSGHNAWLSYHVVQASEPGLFSLGLRTGEVRMVRALGDKDSVRQRLLVAVRDGGQPPLSATATLHLVFADSLQEVLPDFSDHPTPSDSQAEMQFYLVVALALISVLFLLAVILAIALRLRQSFSPTAGDCFESVLCSKSGPVGPPNYSEGTLPYAYNFCVPGDQMNPEFNFFTSVDHCPATQDNLNKDSMLLASILTPSVEADKKILKQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60364 - protein, 934 aa, Homo sapiens
MVPEAWRSGLVSTGRVVGVLLLLGALNKASTVIHYEIPEEREKGFAVGNVVANLGLDLGSLSARRFRVVSGASRRFFEVNRETGEMFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPREQKKNLTFYLLLSLILVSVGFVVTVFGVIIFKVYKWKQSRDLYRAPVSSLYRTPGPSLHADAVRGGLMSPHLYHQVYLTTDSRRSDPLLKKPGAASPLASRQNTLRSCDPVFYRQVLGAESAPPGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60365 - protein, 938 aa, Homo sapiens
MLRKVRSWTEIWRWATLLFLFYHLGYVCGQIRYPVPEESQEGTFVGNVAQDFLLDTDSLSARRLQVAGEVNQRHFRVDLDSGALLIKNPIDREALCGLSASCIVPLEFVTEGPLEMYRAEVEIVDVNDHAPRFPRQQLDLEIGEAAPPGQRFPLEKAQDADVGSNSISSYRLSSNEHFALDVKKRSDGSLVPELLLEKPLDREKQSDYRLVLTAVDGGNPPRSGTAELRVSVLDVNDNAPAFQQSSYRISVLESAPAGMVLIQLNASDPDLGPSGNVTFYFSGHTPDRVRNLFSLHPTTGKLTLLGPLDFESENYYEFDVRARDGGSPAMEQHCSLRVDLLDVNDNAPYITVTSELGTLPESAEPGTVVALISVQDPDSGSNGDVSLRIPDHLPFALKSAFRNQFSLVTAGPLDREAKSSYDIMVTASDAGNPPLSTHRTIFLNISDVNDNPPSFFQRSHEVFVPENNRPGDLLCSLAASDPDSGLNALISYSLLEPRNRDVSASSFISLNPQTGAVHATRSFDYEQTQTLQFEVQARDRGNPPLSSTVTVRLFVLDLNDNAPAVLRPRARPGSLCPQALPPSVGAGHLITKVTAVDLDSGYNAWVSYQLLEAPDPSLFAVSRYAGEVRTAVPIPADLPPQKLVIVVKDSGSPPLSTSVTLLVSLEEDTHPVVPDLRESSAPREGESRLTLYLAVSLVAICFVSFGSFVALLSKCLRGAACGVTCFPAGTCACLTRSRRREGLPPSNGILRIQLGSDDPIKFVDVGGHSHGCTPLASAPTRSDSFMMVKSPSAPMAGEPVRPSCPPSDLLYGLEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60366 - protein, 944 aa, Homo sapiens
MGPKTLPQLAGKWQVLCMLSLCCWGWVSGQLRYSVVEESEPGTLVGNVAQDLGLKMTDLLSRRLQLGSEENGRYFSLSLMSGALAVNQKIDRESLCGASTSCLLPVQVVTEHPLELIRVEVEILDLNDNSPSFATPEREMRISESAASGARFPLDSAQDPDVGTNTVSFYTLSPNSHFSLNVKTLKDGKPFPELVLEQQLDREAQARHQLVLTAVDGGTPARSGTTLISVIVLDINDNAPTFQSSVLRVGIPENAPIGTLLLRLNATDPDEGTNGQLDYSFGDHTSEAVRNLFGLDPSSGAIHVLGPIDFEESRFYEIHARARDQGQPAMEGHCVIQVDVGDVNDNAPEVLLASLANPVLESTPVGTVVGLFNVRDRDSGRNGEVSLDISPDLPFQIKPSENHYSLLTSQPLDREATSHYIIELLASDAGSPSLHKHLTIRLNISDVNDNAPRFNQQLYTAYILENRPPGSLLCTVAASDPDTGDNARLTYSIVGNQVQGAPASSFVYVNPEDGRIFAQRTFDYELLQMLQIVVGVRDSGSPPLHANTSLHVFVLDENDNAPAVLHPRPDWEHSAPQRLPRSAPPGSLVTKVTAVDADAGHNAWLSYSLLPQSTAPGLFLVSTHTGEVRTARALLEDDSDTQQVVVLVRDNGDPSLSSTATVLLVLEDEDPEEMPKSSDFLIHPPERSDLTLYLIVALATVSLLSLVTFTFLSAKCLQGNADGDGGGGQCCRRQDSPSPDFYKQSSPNLQVSSDGTLKYMEVTLRPTDSQSHCYRTCFSPASDGSDFTFLRPLSVQQPTALALEPDAIRSRSNTLRERSQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 60367 - protein, 1955 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 60368 - protein, 1957 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 60369 - protein, 961 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPVSRRH

SEQ ID NO: 60370 - protein, 809 aa, Homo sapiens
MFRQFYLWTCLASGIILGSLFEICLGQYDDGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 60371 - protein, 1684 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 60372 - protein, 1952 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 60373 - protein, 1915 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 60374 - protein, 1932 aa, Homo sapiens
MFRQFYLWTCLASGIILGSLFEICLGQYDDGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 60375 - protein, 1539 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKNYPWSLELILARNMDKIITVMSMGMKCLNMGVAVDCYHQLDRRNMVRWLVKLRKNMRRKRKSQRKLKNQRLKLESLVRRKK

SEQ ID NO: 60376 - protein, 719 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 60377 - protein, 650 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 60378 - protein, 1785 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 60379 - protein, 981 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 60380 - protein, 1150 aa, Homo sapiens
MPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKNYPWSLELILARNMDKIITVMSMGMKCLNMGVAVDCYHQLDRRNMVRWLVKLRKNMRRKRKSQRKLKNQRLKLESLVRRKK

SEQ ID NO: 60381 - protein, 329 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPDLGSLCSGTNSWCQGRSGVHWSSPAWRCLFPRRLHQM

SEQ ID NO: 60382 - protein, 1681 aa, Homo sapiens
MFRQFYLWTCLASGIILGSLFEICLGQYDDGWRYMYCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSILYYRYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 60383 - protein, 1962 aa, Homo sapiens
MFRQFYLWTCLASGIILGSLFEICLGQYDDAYSYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRHFKRRQAECTKTARIQAALPAAKPAVPAPAPVAAPPPPPPPPPGAHLYEELGDSSMKGLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 60384 - protein, 1886 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERSTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRHFKRRQAECTKTARIQAALPAAKPAVPAPAPVAAPPPPPPPPPGAHLYEELGDSSMKGLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 60385 - protein, 654 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQHGDSNLRESTGQGKH

SEQ ID NO: 60386 - protein, 1677 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRHFKRRQAECTKTARIQAALPAAKPAVPAPAPVAAPPPPPPPPPGAHLYEELGDSSIYRYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 60387 - protein, 92 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQ

SEQ ID NO: 60388 - protein, 1150 aa, Homo sapiens
MAPPLRPLARLRPPGMLLRALLLLLLLSPLPGVWCFSELSFVKEPQDVTVTRKDPVVLDCQAHGEVPIKVTWLKNGAKMSENKRIEVLSNGSLYISEVEGRRGEQSDEGFYQCLAMNKYGAILSQKAHLALSTISAFEVQPISTEVHEGGVARFACKISSHPPAVITWEFNRTTLPMTMDRITALPTGVLQIYDVSQRDSGNYRCIAATVAHRRKSMEASLTVIPAKESKSFHTPTIIAGPQNITTSLHQTVVLECMATGNPKPIISWSRLDHKSIDVFNTRVLGNGNLMISDVRLQHAGVYVCRATTPGTRNFTVAMATLTVLAPPSFVEWPESLTRPRAGTARFVCQAEGIPSPKMSWLKNGRKIHSNGRIKMYNSKLVINQIIPEDDAIYQCMAENSQGSILSRARLTVVMSEDRPSAPYNVHAETMSSSAILLAWERPLYNSDKVIAYSVHYMKAEGLNNEEYQVVIGNDTTHYIIDDLEPASNYTFYIVAYMPMGASQMSDHVTQNTLEDVPLRPPEISLTSRSPTDILISWLPIPAKYRRGQVVLYRLSFRLSTENSIQVLELPGTTHEYLLEGLKPDSVYLVRITAATRVGLGESSVWTSHRTPKATSVKAPKSPELHLEPLNCTTISVRWQQDVEDTAAIQGYKLYYKEEGQQENGPIFLDTKDLLYTLSGLDPRRKYHVRLLAYNNIDDGYQADQTVSTPGCVSVRDRMVPPPPPPHHLYAKANTSSSIFLHWRRPAFTAAQIINYTIRCNPVGLQNASLVLYLQTSETHMLVQGLEPNTKYEFAVRLHVDQLSSPWSPVVYHSTLPEAPAGPPVGVKVTLIEDDTALVSWKPPDGPETVVTRYTILYASRKAWIAGEWQVLHREGAITMALLENLVAGNVYIVKISASNEVGEGPFSNSVELAVLPKETSESNQRPKRLDSADAKVYSGYYHLDQKSMTGIAVGVGIALTCILICVLILIYRSKARKSSASKTAQNGTQQLPRTSASLASGNEVGKNLEGAVGNEESLMPMIMPNSFIDAKGGTDLIINSYGPIIKNNSKKKWFFFQDSKKIQVEQPQRRFTPAVCFYQPGTTVLISDEDSPSSPGQTTSFSRPFGVAADTEHSANSEGSHETGDSGRFSHESNDEIHLSSVISTTPPNL

SEQ ID NO: 60389 - protein, 477 aa, Homo sapiens
MGRTVVVLGGGISGLAASYHLSRAPCPPKVVLVESSERLGGWIRSVRGPNGAIFELGPRGIRPAGALGARTLLLVSELGLDSEVLPVRGDHPAAQNRFLYVGGALHALPTGLRGLLRPSPPFSKPLFWAGLRELTKPRGKEPDETVHSFAQRRLGPEVASLAMDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 60390 - protein, 477 aa, Homo sapiens; identical to SEQ ID NO: 60389

SEQ ID NO: 60391 - protein, 238 aa, Homo sapiens
MGRTVVVLGGGISGLAASYHLSRAPCPPKVVLVESSERLGGWIRSVRGPNGAIFELGPRGIRPAGALGARTLLLGFGHLVPSSEDPGVLGIVYDSVAFPEQDGSPPGLRVTVMLGGSWLQTLEASGCVLSQELFQQRAQEAAATQLGLKEMPSHCLVHLHKTKNQLKWRQSHDRTVEWPKEYPGRSRKQAPSILHVPGCQLLRCRDRDHLGAVSEQPRSSAESRVGVASSTFSTFPLF

SEQ ID NO: 60392 - protein, 444 aa, Homo sapiens
MGRTVVVLGGGISGLAASYHLSRAPCPPKVVLVESSERLGGWIRSVRGPNGAIFELGPRGIRPAGALGARTLLLACGEQVSELGLDSEVLPVRGDHPAAQNRFLYVGGALHALPTGLSPSLTLKVASLAMDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 60393 - protein, 47 aa, Homo sapiens
MDILKSEILRKRQLVEDRNLLSESMCANDAYLQMAIGNAPWPIGVTM

SEQ ID NO: 60394 - protein, 167 aa, Homo sapiens
MIRTFPGENKKYFKRSELAKKEEEAYFERCGYKIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDH

SEQ ID NO: 60395 - protein, 249 aa, Homo sapiens
MIRTFPGENKKYFKRSELAKKEEEAYFERCGYKPINEKPSGEIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDHKDMDIITKFLKFLLGVWAKELNAREDYVKRSVQGKLNSATQKQTESYLRPLFRKLRKRNLPADIKESITDIIK

SEQ ID NO: 60396 - protein, 342 aa, Homo sapiens
MDILKSEILRKRQLVEDRNLLVENKKYFKRSELAKKEEEAYFERCGYKIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDHKDMDIITKFLKFLLGVWAKELNAREDYVKRSVQGKLNSATQKQTESYLRPLFRKLRKRNLPADIKESITDIIKFMLQREYVKANDAYLQMAIGNAPWPIGVTMVGIHARTGREKIFSKHVAHVLNDETQRKYIQGLKRLMTICQKHFPTDPSKCVEYNAL

SEQ ID NO: 60397 - protein, 249 aa, Homo sapiens; identical to SEQ ID NO: 60395

SEQ ID NO: 60398 - protein, 504 aa, Homo sapiens
MSLICSISNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREALATLKPQAGLIVPQAVPSSQPSVVGAGEPMDLGELVGMTPEIIQKLQDKATVLTTERKKRGKTVPEELVKPEELSKYRQVASHVGLHSASIPGILALDLCPSDTNKILTGGADKNVVVFDKSSEQILATLKGHTKKVTSVVFHPSQDLVFSASPDATIRIWSVPNASCVQVVRAHESAVTGLSLHATGDYLLSSSDDQYWAFSDIQTGRVLTKVTDETSGCSLTCAQFHPDGLIFGTGTMDSQIKIWDLKERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 60399 - protein, 364 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQRRRWLRPTRSISPAWLSSSRSRARRVALCPPE

SEQ ID NO: 60400 - protein, 499 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIEEDAYQEDLGFSLGHLGKSGSGRVRQTQVNEATKARISKTLQRTLQKQSVVYGGKSTIRDRSSGTASSVAFTPLQGLEIVNPQAAEKKVAEANQKYFSSMAEFLKVKGEKSGLMST

SEQ ID NO: 60401 - protein, 450 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIEEDAYQEDLGFSLGHLDAAADPAEAERRIWREVHHPRPLLGHGLQRGLHPTPGPGDCEPTGGREEGG

SEQ ID NO: 60402 - protein, 276 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYH

SEQ ID NO: 60403 - protein, 284 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLP

SEQ ID NO: 60404 - protein, 261 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSG

SEQ ID NO: 60405 - protein, 522 aa, Homo sapiens
MASSRASSTQATKTKAPDDLVAPVVKKPHIYYGSLEEKERERLAKGESGILGKDGLKAGIEAGNINITSGEVFEIEEHISERQAEVLAEFERRKRARQINVSTDDSEVKACLRALGEPITLFGEGPAERRERLRNILSVVGTDALKKTKKDDEKSKKSKEEYQQTWYHEGPNSLKVARLWIANYSLPRAMKRLEEARLHKEIPETTRTSQMQELHKSLRSLNNFCSQIGDDRPISYCHFSPNSKMLATACWSGLCKLWSVPDCNLLHTLRGHNTNVGAIVFHPKSTVSLDPKDVNLASCAADGSVKLWSLDSDEPVADIEGHTVRVARVMWHPSGRFLGTTCYDRSWRLWDLEAQEEILHQEGHSMGVYDIAFHQDGSLAGTGGLDAFGRVWDLRTGRCIMFLEGHLKEIYGINFSPNGYHIATGSGDNTCKVWDLRQRRCVYTIPAHQNLVTGVKFEPIHGNFLLTGAYDNTAKIWTHPGWSPLKTLAGHEGKVMGLDISSDGQLIATCSYDRTFKLWMAE

SEQ ID NO: 60406 - protein, 521 aa, Homo sapiens
MASSRASSTATKTKAPDDLVAPVVKKPHIYYGSLEEKERERLAKGESGILGKDGLKAGIEAGNINITSGEVFEIEEHISERQAEVLAEFERRKRARQINVSTDDSEVKACLRALGEPITLFGEGPAERRERLRNILSVVGTDALKKTKKDDEKSKKSKEEYQQTWYHEGPNSLKVARLWIANYSLPRAMKRLEEARLHKEIPETTRTSQMQELHKSLRSLNNFCSQIGDDRPISYCHFSPNSKMLATACWSGLCKLWSVPDCNLLHTLRGHNTNVGAIVFHPKSTVSLDPKDVNLASCAADGSVKLWSLDSDEPVADIEGHTVRVARVMWHPSGRFLGTTCYDRSWRLWDLEAQEEILHQEGHSMGVYDIAFHQDGSLAGTGGLDAFGRVWDLRTGRCIMFLEGHLKEIYGINFSPNGYHIATGSGDNTCKVWDLRQRRCVYTIPAHQNLVTGVKFEPIHGNFLLTGAYDNTAKIWTHPGWSPLKTLAGHEGKVMGLDISSDGQLIATCSYDRTFKLWMAE

SEQ ID NO: 60407 - protein, 1007 aa, Homo sapiens
MAAAETQSLREQPEMEDANSEKSINEENGEVSEDQSQNKHSRHKKKKHKHRSKHKKHKHSSEEDKDKKHKHKHKHKKHKRKEIIDASDKEGMSPAKRTKLDDLALLEDLEKQRALIKAELDNELMEGKVQSGMGLILQGYESGSEEEGEIHEKARNGNRSSTRSSSTKGKLELVDNKITTKKRSKSRSKERTRHRSDKKKSKGGIEIVKEKTTRSKSKERKKSKSPSKRSKSQDQARKSKSPTLRRRSQEKIGKARSPTDDKVKIEDKSKSKDRKKSPIINESRSRDRGKKSRSPVDLRGKSKDRRSRSKERKSKRSETDKEKKPIKSPSKDASSGKENRSPSRRPGRSPKRRSLSPKPRDKSRRSRSPLLNDRRSKQSKSPSRTLSPGRRAKSRSLERKRREPERRRLSSPRTRPRDDILSRRERSKDASPINRWSPTRRRSRSPIRRRSRSPLRRSRSPRRRSRSPRRRDRGRRSRSRLRRRSRSRGGRRRRSRSKVKEDKFKGSLSEGMKVEQESSSDDNLEDFDVEEEDEEALIEQRRIQRQAIVQKYKYLAEDSNMSVPSEPSSPQSSTRTRSPSPDDILERVAADVKEYERENVDTFEASVKAKHNLMTVEQNNGSSQKKLLAPDMFTESDDMFAAYFDSARLRAAGIGKDFKENPNLRDNWTDAEGYYRVNIGEVLDKRYNVYGYTGQGVFSNVVRARDNARANQEVAVKIIRNNELMQKTGLKELEFLKKLNDADPDDKFHCLRLFRHFYHKQHLCLVFEPLSMNLREVLKKYGKDVGLHIKAVRSYSQQLFLALKLLKRCNILHADIKPDNILVNESKTILKLCDFGSASHVADNDITPYLVSRFYRAPEIIIGKSYDYGIDMWSVGCTLYELYTGKILFPGKTNNHMLKLAMDLKGKMPNKMIRKGVFKDQHFDQNLNFMYIEVDKVTEREKVTVMSTINPTKDLLADLIGCQRLPEDQRKKVHQLKDLLDQILMLDPAKRISINQALQHAFIQEKI

SEQ ID NO: 60408 - protein, 1007 aa, Homo sapiens; identical to SEQ ID NO: 60407

SEQ ID NO: 60409 - protein, 993 aa, Homo sapiens [sequence omitted]

SEQ ID NO: 60410 - protein, 939 aa, Homo sapiens
MRPGTGAERGGLMVSEMESHPPSQGPGDGERRLSGSSLCSGSWVSADGFLRRRPSMGHPGMHYAPMGMHPMGQRANMPPVPHGMMPQMMPPMGGPPMGQMPGMMSSVMPGMMMSHMSQASMQPALPPGVNSMDVAAGTYTLYKSMWTEHKSPDGRTYYYNTETKQSTWEKPDDLKTPAEQLLSKCPWKEYKSDSGKPYYYNSQTKESRWAKPKELEDLEGKMGKIKYSKQEECTTTSTAPVPTTEIPTTMSTMAAAEAAAAVVAAAAAAAAAAAAANANASTSASNTVSGTVPVVPEPEVTSIVATVVDNENTVTISTEEQAQLTSTPAIQDQSVEVSSNTGEETSKQETVADFTPKKEEEESQPAKKTYTWNTKEEAKQAFKELLKEKRVPSNASWEQAMKMIINDPRYSALAKLSEKKQAFNAYKVQTEKEEKEEARSKYKEAKESFQRFLENHEKMTSTTRYKKAEQMFGEMEVWNAISERDRLEIYEDVLFFLSKKEKEQAKQLRKRNWEALKNILDNMANVTYSTTWSEAQQYLMDNPTFAEDEELQNMDKEDALICFEEHIRALEKEEEEEKQKSLLRERRRQRKNRESFQIFLDELHEHGQLHSMSSWMELYPTISSDIRFTNMLGQPGSTALDLFKFYVEDLKARYHDEKKIIKDILKDKGFVVEVNTTFEDFVAIISSTKRSTTLDAGNIKLAFNSLLEKAEAREREREKEEARKMKRKESAFKSMLKQAAPPIELDAVWEDIRERFVKEPAFEDITLESERKRIFKDFMHVLEHECQHHHSKNKKHSKKSKKHHRKRSRSRSGSDSDDDDSHSKKKRQRSESRSASEHSSSAESERSYKKSKKHKKKSKKRRHKSDSPESDAEREKDKKEKDRESEKDRTRQRSESKHKSPKKKTGKDSGNWDTSGSELSEGELEKRRRTLLEQLDDDQ

SEQ ID NO: 60411 - protein, 816 aa, Homo sapiens
MCSGSGRRRSSLSPTMRPGTGAERGGLMMGHPGMHYAPMGMHPMGQRANMPPVPHGMMPQMMPPMGGPPMGQMPGMMSSVMPGMMMSHMSQASMQPALPQLLSKCPWKEYKSDSGKPYYYNSQTKESRWAKPKELEDLEGYQNTIVAGSLITKSNLHGMLTELKYSKQEECTTTSTAPVPTTEIPTTMSTMAAAEAAAAVVAAAAAAAAAAAAANANASTSASNTVSGTVPVVPEPEVTSIVATVVDNENTVTISTEEQAQLTSTPAIQDQSVEVSSNTGEETSKQETVADFTPKKEEEESQPAKKTYTWNTKEEAKQAFKELLKEKRVPSNASWEQAMKMIINDPRYSALAKLSEKKQAFNAYKVQTEKEEKEEARSKYKEAKESFQRFLENHEKMTSTTRYKKAEQMFGEMEVWNAISERDRLEIYEDVLFFLSKKEKEQAKQLRKRNWEALKNILDNMANVTYSTTWSEAQQYLMDNPTFAEDEELQNMDKEDALICFEEHIRALEKEEEEEKQKSLLRERRRQRKNRESFQIFLDELHEHGQLHSMSSWMELYPTISSDIRFTNMLGQPVFSLGSTALDLFKFYVEDLKARYHDEKKIIKDILKDKGFVVEVNTTFEDFVAIISSTKRSTTLDAGNIKLAFNSLLEKAEAREREREKEEARKMKRKESAFKSMLKQAAPPIELDAVWEDIRERFVKEPAFEDITLESERKRIFKDFMHVLEHECQHHHSKNKKHSKKSKKHHRKRSRSRSGSDSDDDDSHSKKKRQRSESRSASEHSSSAESERSYKKSKKHKKKSKKRRHKSDSPESDAER

SEQ ID NO: 60412 - protein, 930 aa, Homo sapiens
MCSGSGRRRSSLSPTMRPGTGAERGGLMMGHPGMHYAPMGMHPMGQRANMPPVPHGMMPQMMPPMGGPPMGQMPGMMSSVMPGMMMSHMSQASMQPALPPGVNSMDVAAGTASGAKSMWTEHKSPDGRTYYYNTETKQSTWEKPDDLKTPAEQLLSKCPWKEYKSDSGKPYYYNSQTKESRWAKPKELEDLEGYQNTIVAGSLITKSNLHAMIKAEESSKQEECTTTSTAPVPTTEIPTTMSTMAAAEAAAAVVAAAAAAAAAAAAANANASTSASNTVSGTVPVVPEPEVTSIVATVVDNENTVTISTEEQAQLTSTPAIQDQSVEVSSNTGEETSKQETVADFTPKKEEEESQPAKKTYTWNTKEEAKQAFKELLKEKRVPSNASWEQAMKMIINDPRYSALAKLSEKKQAFNAYKVQTEKEEKEEARSKYKEAKESFQRFLENHEKMTSTTRYKKAEQMFGEMEVWNAISERDRLEIYEDVLFFLSKKEKEQAKQLRKRNWEALKNILDNMANVTYSTTWSEAQQYLMDNPTFAEDEELQNMDKEDALICFEEHIRALEKEEEEEKQKSLLRERRRQRKNRESFQIFLDELHEHGQLHSMSSWMELYPTISSDIRFTNMLGQPGSTALDLFKFYVEDLKARYHDEKKIIKDILKDKGFVVEVNTTFEDFVAIISSTKRSTTLDAGNIKLAFNSLLEKAEAREREREKEEARKMKRKESAFKSMLKQAAPPIELDAVWEDIRERFVKEPAFEDITLESERKRIFKDFMHVLEHECQHHHSKNKKHSKKSKKHHRKRSRSRSGSDSDDDDSHSKKKRQRSESRSASEHSSSAESERSYKKSKKHKKKSKKRRHKSDSPESDAEREKDKKEKDRESEKDRTRQRSESKHKSPKKKTGKDSGNWDTSGSELSEGELEKRRRTLLEQLDDDQ

SEQ ID NO: 60413 - protein, 826 aa, Homo sapiens
MDVAAGTASGAKSMWTEHKSPDGRTYYYNTETKQSTWEKPDDLKTPAEQLLSKCPWKEYKSDSGKPYYYNSQTKESRWAKPKELEDLEGYQNTIVAGSLITKSNLHGMLTELKYSKQEECTTTSTAPVPTTEIPTTMSTMAAAEAAAAVVAAAAAAAAAAAAANANASTSASNTVSGTVPVVPEPEVTSIVATVVDNENTVTISTEEQAQLTSTPAIQDQSVEVSSNTGEETSKQETVADFTPKKEEEESQPAKKTYTWNTKEEAKQAFKELLKEKRVPSNASWEQAMKMIINDPRYSALAKLSEKKQAFNAYKVQTEKEEKEEARSKYKEAKESFQRFLENHEKMTSTTRYKKAEQMFGEMEVWNAISERDRLEIYEDVLFFLSKKEKEQAKQLRKRNWEALKNILDNMANVTYSTTWSEAQQYLMDNPTFAEDEELQNMDKEDALICFEEHIRALEKEEEEEKQKSLLRERRRQRKNRESFQIFLDELHEHGQLHSMSSWMELYPTISSDIRFTNMLGQPGSTALDLFKFYVEDLKARYHDEKKIIKDILKDKGFVVEVNTTFEDFVAIISSTKRSTTLDAGNIKLAFNSLLEKAEAREREREKEEARKMKRKESAFKSMLKQAAPPIELDAVWEDIRERFVKEPAFEDITLESERKRIFKDFMHVLEHECQHHHSKNKKHSKKSKKHHRKRSRSRSGSDSDDDDSHSKKKRQRSESRSASEHSSSAESERSYKKSKKHKKKSKKRRHKSDSPESDAEREKDKKEKDRESEKDRTRQRSESKHKSPKKKTGKDSGNWDTSGSELSEGELEKRRRTLLEQLDDDQ

SEQ ID NO: 60414 - protein, 448 aa, Homo sapiens
MRPGTGAERGGLMVSEMESHPPSQGPGDGERRLSGSSLCSGSWVSADGFLRRRPSMGHPGMHYAPMGMHPMGQRANMPPVPHGMMPQMMPPMGGPPMGQMPGMMSSVMPGMMMSHMSQASMQPALPPGVNSMDVAAGTASGAKSMWTEHKSPDGRTYYYNTETKQSTWEKPDDLKTPAEQLLSKCPWKEYKSDSGKPYYYNSQTKESRWAKPKELEDLEGYQNTIVAGSLITKSNLHAMIKAEESSKQEECTTTSTAPVPTTEIPTTMSTMAAAEAAAAVVAAAAAAAAAAAAANANASTSASNTVSGTVPVVPEPEVTSIVATVVDNENTVTISTEEQAQLTSTPAIQDQSVEVSSNTGEETSKQETVADFTPKKEEEESQPAKKTYTWNTKEEAKQAFKELLKEKRVPSNASWEQAMKMIINDPRYSALAKLSEKKQAFNAYKVQT

SEQ ID NO: 60415 - protein, 941 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEQQEEVRKRCESAEPRHGELWCAVSKDIANWQKKIGDILRLVAGRIKNTF

SEQ ID NO: 60416 - protein, 901 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEQQEEVRKRCESAEPRHGELWCAVSKDIANWQKKIGDILRLVAGRIKNTF

SEQ ID NO: 60417 - protein, 2335 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 60418 - protein, 463 aa, Homo sapiens
MIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSYSEVGSLQQASHTTGAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLIL

SEQ ID NO: 60419 - protein, 324 aa, Homo sapiens
MLKSCSRASFSPSVRKPPLILRRLLSEDVGMDIPFEEGVLSPSAADMRPEPPNSLDLNDTHPRRIKLTAPNINLSLDQSEGSILSDDNLDSPDEIDINVDELDTPDEADSFEYTGHEDPTANKDSGQESESIPEYTAEEEREDNRLWRTVVIGEQEQRIDMKVIEPYRRVISHGGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIINIDLKLKEKP

SEQ ID NO: 60420 - protein, 353 aa, Homo sapiens
MLKSCSRASFSPSVRKPPLILRRLLSEDVGMDIPFEEGVLSPSAADMRPEPPNSLDLNDTHPRRIKLTAPNINLSLDQSEGSILSDDNLDSPDEIDINVDELDTPDEADSFEYTGHEDPTANKDSGQESESIPEYTAEEEREDNRLWRTVVIGEQEQRIDMKVIEPYRRVISHGGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKLDEELREASEAAKTSCLYNDPEMSSMEKDIDLKLKEKP

SEQ ID NO: 60421 - protein, 3088 aa, Homo sapiens
MEEFLQRAKSKLNRSKRLEKVHVVIGPKSCDLDSLISTFTYAYFLDKVSPPGVLCLPVLNIPRTEFNYFTETRFILEELNISESFHIFRDEINLHQLNDEGKLSITLVGSSVLASEDKTLESAVVKVINPVEQSDANVEFRESSSSLVLKEILQEAPELITEQLAHRLRGSILFKWMTMESEKISEKQEEILSILEEKFPNLPPREDIINVLQETQFSAQGLSIEQTMLKDLKELSDGEIKVAISTVSMNLENCLFHSNITSDLKAFTDKFGFDVLILFSSYLSEEQQPRRQIAVYSENMELCSQICCELEECQNPCLELEPFDCGCDEILVYQQEDPSVTCDQVVLVVKEVINRRCPEMVSNSRTSSTEAVAGSAPLSQGSSGIMELYGSDIEPQPSSVNFIENPPDLNDSNQAQVDANVDLVSPDSGLATIRSSRSSKESSVFLSDDSPVGEGAGPHHTLLPGLDSYSPIPEGAVAEEHAWSGEHGEHFDLFNFDPAPMASGQSQQSSHSADYSPADDFFPNSDLSEGQLPAGPEGLDGMGTNMSNYSSSSLLSGAGKDSLVEHDEEFVQRQDSPRDNSERNLSLTDFVGDESPSPERLKNTGKRIPPTPMNSLVESSPSTEEPASLYTEDMTQKATDTGHMGPPQTHARCSSWWGGLEIDSKNIADAWSSSEQESVFQSPESWKEHKPSSIDRRASDSVFQPKSLEFTKSGPWESEFGQPELGSNDIQDKNEESLPFQNLPMEKSPLPNTSPQGTNHLIEDFASLWHSGRSPTAMPEPWGNPTDDGEPAAVAPFPAWSAFGKEDHDEALKNTWNLHPTSSKTPSVRDPNEWAMAKSGFAFSSSELLDNSPSEINNEAAPEIWGKKNNDSRDHIFAPGNPSSDLDHTWTNSKPPKEDQNGLVDPKTRGKVYEKVDSWNLFEENMKKGGSDVLVPWEDSFLSYKCSDYSASNLGEDSVPSPLDTNYSTSDSYTSPTFAGDEKETEHKPFAKEEGFESKDGNSTAEETDIPPQSLQQSSRNRISSGPGNLDMWASPHTDNSSEINTTHNLDENELKTEHTDGKNISMEDDVGESSQSSYDDPSMMQLYNETNRQLTLLHSSTNSRQTAPDSLDLWNRVILEDTQSTATISDMDNDLDWDDCSGGAAIPSDGQTEGYMAEGSEPETRFTVRQLEPWGLEYQEANQVDWELPASDEHTKDSAPSEHHTLNEKSGQLIANSIWDSVMRDKDMSSFMLPGSSHITDSEQRELPPEIPSHSANVKDTHSPDAPAASGTSESEALISHLDKQDTERETLQSDAASLATRLENPGYFPHPDPWKGHGDGQSESEKEAQGATDRGHLDEEEVIASGVENASGISEKGQSDQELSSLVASEHQEICIKSGKISSLAVTFSPQTEEPEEVLEYEEGSYNLDSRDVQTGMSADNLQPKDTHEKHLMSQRNSGETTETSDGMNFTKYVSVPEKDLEKTEECNFLEPENVGGGPPHRVPRSLDFGDVPIDSDVHVSSTCSEITKNLDVKGSENSLPGAGSSGNFDRDTISSEYTHSSASSPELNDSSVALSSWGQQPSSGYQEENQGNWSEQNHQESELITTDGQVEIVTKVKDLEKNRINEFEKSFDRKTPTFLEIWNDSVDGDSFSSLSSPETGKYSEHSGTHQESNLIASYQEKNEHDISATVQPEDARVISTSSGSDDDSVGGEESIEEEIQVANCHVAEDESRAWDSLNESNKFLVTADPKSENIYDYLDSSEPAENENKSNPFCDNQQSSPDPWTFSPLTETEMQITAVEKEKRSSPETGTTGDVAWQISPKASFPKNEDNSQLEMLGFSADSTEWWKASPQEGRLIESPFERELSDSSGVLEINSSVHQNASPWGVPVQGDIEPVETHYTNPFSDNHQSPFLEGNGKNSHEQLWNIQPRQPDPDADKFSQLVKLDQIKEKDSREQTFVSAAGDELTPETPTQEQCQDTMLPVCDHPDTAFTHAEENSCVTSNVSTNEGQETNQWEQEKSYLGEMTNSSIATENFPAVSSPTQLIMKPGSEWDGSTPSEDSRGTFVPDILHGNFQEGGQLASAAPDLWIDAKKPFSLKADGENPDILTHCEHDSNSQASDSPDICHDSEAKQETEKHLSACMGPEVESSELCLTEPEIDEEPIYEPGREFVPSNAELDSENATVLPPIGYQADIKGSSQPASHKGSPEPSEINGDNSTGLQVSEKGASPDMAPILEPVDRRIPRIENVATSIFVTHQEPTPEGDGSWISDSFSPESQPGARALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEISELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKSDTRSSFESPAQDQSWMFLGHSEVGDPSLDARDSGPGWSGKTVEPFSELGLGEGPQLQILEEMKPLESLALEEASGPVSQSQKSKSRGRAGPDAVTLQAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHDPTANKDSGQESESIPEYTAEEEREDNRLWRTVVIGEQEQRIDMKVIEPYRRVISHGGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKLDEELREASEAAKTSCLYNDPEMSSMEKDIDLKLKEKP

SEQ ID NO: 60422 - protein, 3054 aa, Homo sapiens
RNLMHRMKESENRSKRLEKVHVVIGPKSCDLDSLISTFTYAYFLDKVSPPGVLCLPVLNIPRTEFNYFTETRFILEELNISESFHIFRDEINLHQLNDEGKLSITLVGSSVLASEDKTLESAVVKVINPVEQSDANVEFRESSSSLVLKEILQEAPELITEQLAHRLRGSILFKWMTMESEKISEKQEEILSILEEKFPNLPPREDIINVLQETQFSAQGLSIEQTMLKDLKELSDGEIKVAISTVSMNLENCLFHSNITSDLKAFTDKFGFDVLILFSSYLSEEQQPRRQIAVYSENMELCSQICCELEECQNPCLELEPFDCGCDEILVYQQEDPSVTCDQVVLVVKEVINRRCPEMVSNSRTSSTEAVAGSAPLSQGSSGIMELYGSDIEPQPSSVNFIENPPDLNDSNQAQVDANVDLVSPDSGLATIRSSRSSKESSVFLSDDSPVGEGAGPHHTLLPGLDSYSPIPEGAVAEEHAWSGEHGEHFDLFNFDPAPMASGQSQQSSHSADYSPADDFFPNSDLSEGQLPAGPEGLDGMGTNMSNYSSSSLLSGAGKDSLVEHDEEFVQRQDSPRDNSERNLSLTDFVGDESPSPERLKNTGKRIPPTPMNSLVESSPSTEEPASLYTEDMTQKATDTGHMGPPQTHARCSSWWGGLEIDSKNIADAWSSSEQESVFQSPESWKEHKPSSIDRRASDSVFQPKSLEFTKSGPWESEFGQPELGSNDIQDKNEESLPFQNLPMEKSPLPNTSPQGTNHLIEDFASLWHSGRSPTAMPEPWGNPTDDGEPAAVAPFPAWSAFGKEDHDEALKNTWNLHPTSSKTPSVRDPNEWAMAKSGFAFSSSELLDNSPSEINNEAAPEIWGKKNNDSRDHIFAPGNPSSDLDHTWTNSKPPKEDQNGLVDPKTRGKVYEKVDSWNLFEENMKKGGSDVLVPWEDSFLSYKCSDYSASNLGEDSVPSPLDTNYSTSDSYTSPTFAGDEKETEHKPFAKEEGFESKDGNSTAEETDIPPQSLQQSSRNRISSGPGNLDMWASPHTDNSSEINTTHNLDENELKTEHTDGKNISMEDDVGESSQSSYDDPSMMQLYNETNRQLTLLHSSTNSRQTAPDSLDLWNRVILEDTQSTATISDMDNDLDWDDCSGGAAIPSDGQTEGYMAEGSEPETRFTVRQLEPWGLEYQEANQVDWELPASDEHTKDSAPSEHHTLNEKSGQLIANSIWDSVMRDKDMSSFMLPGSSHITDSEQRELPPEIPSHSANVKDTHSPDAPAASGTSESEALISHLDKQDTERETLQSDAASLATRLENPGYFPHPDPWKGHGDGQSESEKEAQGATDRGHLDEEEVIASGVENASGISEKGQSDQELSSLVASEHQEICIKSGKISSLAVTFSPQTEEPEEVLEYEEGSYNLDSRDVQTGMSADNLQPKDTHEKHLMSQRNSGETTETSDGMNFTKYVSVPEKDLEKTEECNFLEPENVGGGPPHRVPRSLDFGDVPIDSDVHVSSTCSEITKNLDVKGSENSLPGAGSSGNFDRDTISSEYTHSSASSPELNDSSVALSSWGQQPSSGYQEENQGNWSEQNHQESELITTDGQVEIVTKVKDLEKNRINEFEKSFDRKTPTFLEIWNDSVDGDSFSSLSSPETGKYSEHSGTHQESNLIASYQEKNEHDISATVQPEDARVISTSSGSDDDSVGGEESIEEEIQVANCHVAEDESRAWDSLNESNKFLVTADPKSENIYDYLDSSEPAENENKSNPFCDNQQSSPDPWTFSPLTETEMQITAVEKEKRSSPETGTTGDVAWQISPKASFPKNEDNSQLEMLGFSADSTEWWKASPQEGRLIESPFERELSDSSGVLEINSSVHQNASPWGVPVQGDIEPVETHYTNPFSDNHQSPFLEGNGKNSHEQLWNIQPRQPDPDADKFSQLVKLDQIKEKDSREQTFVSAAGDELTPETPTQEQCQDTMLPVCDHPDTAFTHAEENSCVTSNVSTNEGQETNQWEQEKSYLGEMTNSSIATENFPAVSSPTQLIMKPGSEWDGSTPSEDSRGTFVPDILHGNFQEGGQLASAAPDLWIDAKKPFSLKADGENPDILTHCEHDSNSQASDSPDICHDSEAKQETEKHLSACMGPEVESSELCLTEPEIDEEPIYEPGREFVPSNAELDSENATVLPPIGYQADIKGSSQPASHKGSPEPSEINGDNSTGLQVSEKGASPDMAPILEPVDRRIPRIENVATSIFVTHQEPTPEGDGSWISDSFSPESQPGARALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEISELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKSDTRSSFESPAQDQSWMFLGHSEVGDPSLDARDSGPGWSGKTVEPFSELGLGEGPQLQILEEMKPLESLALEEASGPVSQSQKSKSRGRAGPDAVTLQAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHEDPTANKDSGQESESIPEYTAEEEREDNRLWRTVVIGEQEQRIDMKVIEPYRRVISHGGSRGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIINY

SEQ ID NO: 60423 - protein, 260 aa, Homo sapiens
IDINVDELDTPDEADSFEYTGHDPTANKDSGQESESIPEYTAEEEREDNRLWRTVVIGEQEQRIDMKVIEPYRRVISHGGDSGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKYDEERSYKRSVRTSCLYNDPEMSSMEKDIDLKLKEKP

SEQ ID NO: 60424 - protein, 2384 aa, Homo sapiens
  MOD_RES (1)..(1): Any amino acid
XFQSPESWKEHKPSSIDRRASDSVFQPKSLEFTKSGPWESEFGQPELGSNDIQDKNEESLPFQNLPMEKSPLPNTSPQGTNHLIEDFASLWHSGRSPTAMPEPWGNPTDDGEPAAVAPFPAWSAFGKEDHDEALKNTWNLHPTSSKTPSVRDPNEWAMAKSGFAFSSSELLDNSPSEINNEAAPEIWGKKNNDSRDHIFAPGNPSSDLDHTWTNSKPPKEDQNGLVDPKTRGKVYEKVDSWNLFEENMKKGGSDVLVPWEDSFLSYKCSDYSASNLGEDSVPSPLDTNYSTSDSYTSPTFAGDEKETEHKPFAKEEGFESKDGNSTAEETDIPPQSLQQSSRNRISSGPGNLDMWASPHTDNSSEINTTHNLDENELKTEHTDGKNISMEDDVGESSQSSYDDPSMMQLYNETNRQLTLLHSSTNSRQTAPDSLDLWNRVILEDTQSTATISDMDNDLDWDDCSGGAAIPSDGQTEGYMAEGSEPETRFTVRQLEPWGLEYQEANQVDWELPASDEHTKDSAPSEHHTLNEKSGQLIANSIWDSVMRDKDMSSFMLPGSSHITDSEQRELPPEIPSHSANVKDTHSPDAPAASGTSESEALISHLDKQDTERETLQSDAASLATRLENPGYFPHPDPWKGHGDGQSESEKEAQGATDRGHLDEEEVIASGVENASGISEKGQSDQELSSLVASEHQEICIKSGKISSLAVTFSPQTEEPEEVLEYEEGSYNLDSRDVQTGMSADNLQPKDTHEKHLMSQRNSGETTETSDGMNFTKYVSVPEKDLEKTEECNFLEPENVGGGPPHRVPRSLDFGDVPIDSDVHVSSTCSEITKNLDVKGSENSLPGAGSSGNFDRDTISSEYTHSSASSPELNDSSVALSSWGQQPSSGYQEENQGNWSEQNHQESELITTDGQVEIVTKVKDLEKNRINEFEKSFDRKTPTFLEIWNDSVDGDSFSSLSSPETGKYSEHSGTHQESNLIASYQEKNEHDISATVQPEDARVISTSSGSDDDSVGGEESIEEEIQVANCHVAEDESRAWDSLNESNKFLVTADPKSENIYDYLDSSEPAENENKSNPFCDNQQSSPDPWTFSPLTETEMQITAVEKEKRSSPETGTTGDVAWQISPKASFPKNEDNSQLEMLGFSADSTEWWKASPQEGRLIESPFERELSDSSGVLEINSSVHQNASPWGVPVQGDIEPVETHYTNPFSDNHQSPFLEGNGKNSHEQLWNIQPRQPDPDADKFSQLVKLDQIKEKDSREQTFVSAAGDELTPETPTQEQCQDTMLPVCDHPDTAFTHAEENSCVTSNVSTNEGQETNQWEQEKSYLGEMTNSSIATENFPAVSSPTQLIMKPGSEWDGSTPSEDSRGTFVPDILHGNFQEGGQLASAAPDLWIDAKKPFSLKADGENPDILTHCEHDSNSQASDSPDICHDSEAKQETEKHLSACMGPEVESSELCLTEPEIDEEPIYEPGREFVPSNAELDSENATVLPPIGYQADIKGSSQPASHKGSPEPSEINGDNSTGLQVSEKGASPDMAPILEPVDRRIPRIENVATSIFVTHQEPTPEGDGSWISDSFSPESQPGARALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEISELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKSDTRSSFESPAQDQSWMFLGHSEVGDPSLDARDSGPGWSGKTVEPFSELGLGEGPQLQILEEMKPLESLALEEASGPVSQSQKSKSRGRAGPDAVTLQAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHDPTANKDSGQESESIPEYTAEEEREDNRLWRTVVIGEQEQRIDMKVIEPYRRVISHGGDSGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIINIDLKLKEKP

SEQ ID NO: 60425 - protein, 2730 aa, Homo sapiens
MVSNSRTSSTEAVAGSAPLSQGSSGIMELYGSDIEPQPSSVNFIENPPDLNDSNQAQVDANVDLVSPDSGLATIRSSRSSKESSVFLSDDSPVGEGAGPHHTLLPGLDSYSPIPEGAVAEEHAWSGEHGEHFDLFNFDPAPMASGQSQQSSHSADYSPADDFFPNSDLSEGQLPAGPEGLDGMGTNMSNYSSSSLLSGAGKDSLVEHDEEFVQRQDSPRDNSERNLSLTDFVGDESPSPERLKNTGKRIPPTPMNSLVESSPSTEEPASLYTEDMTQKATDTGHMGPPQTHARCSSWWGGLEIDSKNIADAWSSSEQESVFQSPESWKEHKPSSIDRRASDSVFQPKSLEFTKSGPWESEFGQPELGSNDIQDKNEESLPFQNLPMEKSPLPNTSPQGTNHLIEDFASLWHSGRSPTAMPEPWGNPTDDGEPAAVAPFPAWSAFGKEDHDEALKNTWNLHPTSSKTPSVRDPNEWAMAKSGFAFSSSELLDNSPSEINNEAAPEIWGKKNNDSRDHIFAPGNPSSDLDHTWTNSKPPKEDQNGLVDPKTRGKVYEKVDSWNLFEENMKKGGSDVLVPWEDSFLSYKCSDYSASNLGEDSVPSPLDTNYSTSDSYTSPTFAGDEKETEHKPFAKEEGFESKDGNSTAEETDIPPQSLQQSSRNRISSGPGNLDMWASPHTDNSSEINTTHNLDENELKTEHTDGKNISMEDDVGESSQSSYDDPSMMQLYNETNRQLTLLHSSTNSRQTAPDSLDLWNRVILEDTQSTATISDMDNDLDWDDCSGGAAIPSDGQTEGYMAEGSEPETRFTVRQLEPWGLEYQEANQVDWELPASDEHTKDSAPSEHHTLNEKSGQLIANSIWDSVMRDKDMSSFMLPGSSHITDSEQRELPPEIPSHSANVKDTHSPDAPAASGTSESEALISHLDKQDTERETLQSDAASLATRLENPGYFPHPDPWKGHGDGQSESEKEAQGATDRGHLDEEEVIASGVENASGISEKGQSDQELSSLVASEHQEICIKSGKISSLAVTFSPQTEEPEEVLEYEEGSYNLDSRDVQTGMSADNLQPKDTHEKHLMSQRNSGETTETSDGMNFTKYVSVPEKDLEKTEECNFLEPENVGGGPPHRVPRSLDFGDVPIDSDVHVSSTCSEITKNLDVKGSENSLPGAGSSGNFDRDTISSEYTHSSASSPELNDSSVALSSWGQQPSSGYQEENQGNWSEQNHQESELITTDGQVEIVTKVKDLEKNRINEFEKSFDRKTPTFLEIWNDSVDGDSFSSLSSPETGKYSEHSGTHQESNLIASYQEKNEHDISATVQPEDARVISTSSGSDDDSVGGEESIEEEIQVANCHVAEDESRAWDSLNESNKFLVTADPKSENIYDYLDSSEPAENENKSNPFCDNQQSSPDPWTFSPLTETEMQITAVEKEKRSSPETGTTGDVAWQISPKASFPKNEDNSQLEMLGFSADSTEWWKASPQEGRLIESPFERELSDSSGVLEINSSVHQNASPWGVPVQGDIEPVETHYTNPFSDNHQSPFLEGNGKNSHEQLWNIQPRQPDPDADKFSQLVKLDQIKEKDSREQTFVSAAGDELTPETPTQEQCQDTMLPVCDHPDTAFTHAEENSCVTSNVSTNEGQETNQWEQEKSYLGEMTNSSIATENFPAVSSPTQLIMKPGSEWDGSTPSEDSRGTFVPDILHGNFQEGGQLASAAPDLWIDAKKPFSLKADGENPDILTHCEHDSNSQASDSPDICHDSEAKQETEKHLSACMGPEVESSELCLTEPEIDEEPIYEPGREFVPSNAELDSENATVLPPIGYQADIKGSSQPASHKGSPEPSEINGDNSTGLQVSEKGASPDMAPILEPVDRRIPRIENVATSIFVTHQEPTPEGDGSWISDSFSPESQPGARALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEISELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKSDTRSSFESPAQDQSWMFLGHSEVGDPSLDARDSGPGWSGKTVEPFSELGLGEGPQLQILEEMKPLESLALEEASGPVSQSQKSKSRGRAGPDAVTLQAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHEDPTANKDSGQESESIPEYTAEEEREDNRLWRTVVIGEQEQRIDMKVIEPYRRVISHGGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKLDEELREASEAAKTSCLYNDPEMSSMEKDIDLKLKEKP

SEQ ID NO: 60426 - protein, 308 aa, Homo sapiens
MRPEPPNSLDLNDTHPRRIKLTAPNINLSLDQSEGSILSDDNLDSPDEIDINVDELDTPDEADSFEYTGHDPTANKDSGQESESIPEYTAEEEREDNRLWRTVVIGEQEQRIDMKVIEPYRRVISHGGKLRYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKYDEERSYKRSVRTSCLYNDPEMSSMEKDIDLKLKEKP

SEQ ID NO: 60427 - protein, 337 aa, Homo sapiens
MNGLRNKQLLSEDVGMDIPFEEGVLSPSAADMRPEPPNSLDLNDTHPRRIKLTAPNINLSLDQSEGSILSDDNLDSPDEIDINVDELDTPDEADSFEYTGHDPTANKDSGQESESIPEYTAEEEREDNRLWRTVVIGEQEQRIDMKVIEPYRRVISHGGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKLDEELREASEAAKTSCLYNDPEMSSMEKDIDLKLKEKP

SEQ ID NO: 60428 - protein, 384 aa, Homo sapiens
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKGVSAAGQVVSLKVWLIDDILEKINSHLPSHIRILGLKRVTGGFNSKNRCDARTYCYLLPTFAFAHKDRDVQDETYRLSAETLQQVNRLLACYKGTHNFHNFTSQKGPQDPSACRYILEMYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAK

SEQ ID NO: 60429 - protein, 427 aa, Homo sapiens
MGLQLRALLGAFGRWTLRLGPRPSCSPRMAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKGVSAAGQVVSLKVWLIDDILEKINSHLPSHIRILGLKRVTGGFNSKNRCDARTYCYLLPTFAFAHKDRDVQDETYRLSAETLQQVNRLLACYKGTHNFHNFTSQKGPQDPSACRYILEMYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAKVPSPLEGSEGDGDTD

SEQ ID NO: 60430 - protein, 399 aa, Homo sapiens
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKGVSAAGQVVSLKVWLIDDILEKINSHLPSHIRILGLKRVTGGFNSKNRCDARTYCYLLPTFAFAHKDRDVQDETYRLSAETLQQVNRLLACYKGTHNFHNFTSQKGPQDPSACRYILEMYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAKVPSPLEGSEGDGDTD

SEQ ID NO: 60431 - protein, 399 aa, Homo sapiens; identical to SEQ ID NO: 60430

SEQ ID NO: 60432 - protein, 154 aa, Homo sapiens
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKGVSAAGQVVSLKVWLIDDILEKINSHLPSHIRILG

SEQ ID NO: 60433 - protein, 205 aa, Homo sapiens
MSKGRAEAAAGAAGILLRYLQEQNRPYSSQDVFGNLQREHGLGKAVVVKTLEQLAQQGKIKEKMYGKQKIYFADQDQFDMVSDADLQVLDGKIVALTAKVQSLQQSCRYMEAEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 60434 - protein, 217 aa, Homo sapiens
MSKGRAEAAAGAAGILLRYLQEQNRPYSSQDVFGNLQREHGLGKAVVVKTLEQLAQQGKIKEKMYGKQKIYFADQDQFDMVSDADLQVLDGKIVALTAKVQSLQQSCRYMEAELKELSSALTTPEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 60435 - protein, 154 aa, Homo sapiens
MYGKQKIYFADQDQFDMVSDADLQVLDGKIVALTAKVQSLQQSCRYMEAELKELSSALTTPEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 60436 - protein, 304 aa, Homo sapiens
MFSVLSYGRLVARAVLGGLSQTDPRAGGGGGGDYGLVTAGCGFGKDFRKGLLKKGACYGDDACFVARHRSADVLGVADGVGGWRDYGVDPSQFSGTLMRTCERLVKEGRFVPSNPIGILTTSYCELLQNKVPLLGSSTACIVVLDRTSHRLHTANLGDSGFLVVRGGEVVHRSDEQQHYFNTPFQLSIAPPEAEGVVLSDSPDAADSTSFDVQLGDIILTATDGLFDNMPDYMILQELKKLKNSNYESIQQTARSIAEQAHELAYDPNYMSPFAQFACDNGLNVRGGKPDDITVLLSIVAEYTD

SEQ ID NO: 60437 - protein, 581 aa, Homo sapiens
MAVRQALGRGLQLGRALLLRFTGKPGRAYGLGRPGPAAGCVRGERPGWAAGPGAEPRRVGLGLPNRLRFFRQSVAGLAARLQRQFVVRAWGCAGPCGRAVFLAFGLGLGLIEEKQAESRRAVSACQEIQAIFTQKSKPGPDPLDTRRLQGFRLEEYLIGQSIGKGCSAAVYEATMPTLPQNLEVTKSTGLLPGRGPGTSAPGEGQERAPGAPAFPLAIKMMWNISAGSSSEAILNTMSQELVPASRVALAGEYGAVTYRKSKRGPKQLAPHPNIIRVLRAFTSSVPLLPGALVDYPDVLPSRLHPEGLGHGRTLFLVMKNYPCTLRQYLCVNTPSPRLAAMMLLQLLEGVDHLVQQGIAHRDLKSDNILVELDPDGCPWLVIADFGCCLADESIGLQLPFSSWYVDRGGNGCLMAPEVSTARPGPRAVIDYSKADAWAVGAIAYEIFGLVNPFYGQGKAHLESRSYQEAQLPALPESVPPDVRQLVRALLQREASKRPSARVAANVLHLSLWGEHILALKNLKLDKMVGWLLQQSAATLLANRLTEKCCVETKMKMLFLANLECETLCQAALLLCSWRAAL

SEQ ID NO: 60438 - protein, 130 aa, Homo sapiens
MAAVLGALGATRRLLAALRGQSLGLAAMSSGTHRLTAEERNQAILDLKAAGWSELSERDAIYKEFSFHNFNQAFGFMSRVALQAEKMNHHPEWFNVYNKVQITLTSHDCGELTKKDVKLAKFIEKAAASV

SEQ ID NO: 60439 - protein, 130 aa, Homo sapiens; identical to SEQ ID NO: 60438

SEQ ID NO: 60440 - protein, 1070 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 60441 - protein, 396 aa, Homo sapiens
MPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 60442 - protein, 1030 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLDGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 60443 - protein, 940 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVANGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 60444 - protein, 1014 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 60445 - protein, 403 aa, Homo sapiens
MGSFLSGEKRPSAPTVGSAMEKKEFPTPPGRVGPGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPMAGSTRRATSWCWPILLKVMLVSTPATRPTWLVSGDRMSTSLWPLCPPG

SEQ ID NO: 60446 - protein, 269 aa, Homo sapiens
FSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVASEHLCPEGQGEVEGNTGLGVMDRGFPAVPSWLKKPQDSQLEEGKPGYLDCLTQATPKPTVVWYRNQMLISEDSRFEVFKNGTLRINSVEVYDGTWYRCMSSTPAGSI

SEQ ID NO: 60447 - protein, 147 aa, Homo sapiens
MGATGLGFLLSWRQDNLNGTDCQGCNILYFSETTGSMCSELSLNRGLEARRKKDLKDSFLWRYGKVGCISLPLREMTAWINPPQISEIFQGYHQRVHGADALSLQTNSLRSRLSSQCLGQSFLLRTLERGRGFRALGDICGHVHEED

SEQ ID NO: 60448 - protein, 71 aa, Homo sapiens
MGATGLGFLLSWRQDNLNGTDCQGCNILYFSETTGSMCSELSLNRGLEARRKKDLKDSFLWRDGVSPCLPC

SEQ ID NO: 60449 - protein, 147 aa, Homo sapiens; identical to SEQ ID NO: 60447

SEQ ID NO: 60450 - protein, 71 aa, Homo sapiens; identical to SEQ ID NO: 60448

SEQ ID NO: 60451 - protein, 1186 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 60452 - protein, 926 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTTVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQVINEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 60453 - protein, 1044 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQVINEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 60454 - protein, 1188 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQVINEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 60455 - protein, 1162 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIAGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQVINEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 60456 - protein, 96 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGG

SEQ ID NO: 60457 - protein, 516 aa, Homo sapiens
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQTEFCFCCPGWSAMV

SEQ ID NO: 60458 - protein, 987 aa, Homo sapiens
MNHDFQALALESRGMGELLPTKKFWEPDDSTKDGQKGIFLGDDEWRETAWGASHHSMSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQVISEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 60459 - protein, 1064 aa, Homo sapiens
MNHDFQALALESRGMGELLPTKKFWEPDDSTKDGQKGIFLGDDEWRETAWGASHHSMSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSVGSSASSSATRRESLSTSSDLYKRSSSSLAPIGQPFYNSLGFSSSPSPIGMPLPSQTPGHSLTPPPSLSSHGSSSSLHLGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQSEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 60460 - protein, 1066 aa, Homo sapiens
MNHDFQALALESRGMGELLPTKKFWEPDDSTKDGQKGIFLGDDEWRETAWGASHHSMSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSVGSSASSSATRRESLSTSSDLYKRSSSSLAPIGQPFYNSLGFSSSPSPIGMPLPSQTPGHSLTPPPSLSSHGSSSSLHLGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQVISEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 60461 - protein, 1064 aa, Homo sapiens; identical to SEQ ID NO: 60459

SEQ ID NO: 60462 - protein, 34 aa, Homo sapiens
MNHDFQALALESRGMGELLPTKKFWEPDDSTKDG

SEQ ID NO: 60463 - protein, 293 aa, Homo sapiens
MNHDFQALALESRGMGELLPTKKFWEPDDSTKDGQKGIFLGDDEWRETAWGASHHSMSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPH

SEQ ID NO: 60464 - protein, 1008 aa, Homo sapiens
MSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSVGSSASSSATRRESLSTSSDLYKRSSSSLAPIGQPFYNSLGFSSSPSPIGMPLPSQTPGHSLTPPPSLSSHGSSSSLHLGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQSEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 60465 - protein, 289 aa, Homo sapiens
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 60466 - protein, 93 aa, Homo sapiens
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPL

SEQ ID NO: 60467 - protein, 399 aa, Homo sapiens
MARRFQEELAAFLFEYDTPRMVLVRNKKVGVIFRLIQLVVLVYVIGWVFLYEKGYQTSSGLISSVSVKLKGLAVTQLPGLGPQVWDVADYVFPAQGDNSFVVMTNFIVTPKQTQGYCAEHPEGGICKEDSGCTPGKAKRKAQGIRTGKCVAFNDTVKTCEIFGWCPVEVDDDIPRPALLREAENFTLFIKNSISFPRFKVNRRNLVEEVNAAHMKTCLFHKTLHPLCPVFQLGYVVQESGQNFSTLAEKGGVVGITIDWHCDLDWHVRHCRPIYEFHGLYEEKNLSPGFNFRFARHFVENGTNYRHLFKVFGIRFDILVDGKAGKFDIIPTMTTIGSGIGIFGVATVLCDLLLLHILPKRHYYKQKKFKYAEDMGPGAAERDLAATSSTLGLQENMRTS

SEQ ID NO: 60468 - protein, 397 aa, Homo sapiens
MNCISDFFTYETTKSVVVKSWTIGIINRVVQLLIISYFVGWVFLHEKAYQVRDTAIESSVVTKVKGSGLYANRVMDVSDYVTPPQGTSVFVIITKMIVTENQMQGFCPESEEKYRCVSDSQCGPERLPGGGILTGRCVNYSSVLRTCEIQGWCPTEVDTVETPIMMEAENFTIFIKNSIRFPLFNFEKGNLLPNLTARDMKTCRFHPDKDPFCPILRVGDVVKFAGQDFAKLARTGGVLGIKIGWVCDLDKAWDQCIPKYSFTRLDSVSEKSSVSPGYNFRFAKYYKMENGSEYRTLLKAFGIRFDVLVYGNAGKFNIIPTIISSVAAFTSVGVGTVLCDIILLNFLKGADQYKAKKFEEVNETTLKIAALTNPVYPSDQTTAEKQSTDSGAFSIGH

SEQ ID NO: 60469 - protein, 396 aa, Homo sapiens [sequence omitted]

SEQ ID NO: 60470 - protein, 388 aa, Homo sapiens
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 60471 - protein, 404 aa, Homo sapiens
MAGCCAALAAFLFEYDTPRIVLIRSRKVGLMNRAVQLLILAYVIGCYHPHLAEVEMESPRRWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 60472 - protein, 146 aa, Homo sapiens
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNDLLF

SEQ ID NO: 60473 - protein, 361 aa, Homo sapiens
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 60474 - protein, 287 aa, Homo sapiens
MTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 60475 - protein, 425 aa, Homo sapiens
MDGPAEQRPALLNSAENFTVLIKNNIDFPGHNYTTRNILPGLNITCTFHKTQNPQCPIFRLGDIFRETGDNFSDVAIQGGIMGIEIYWDCNLDRWFHHCRPKYSFRRLDDKTTNVSLYPGYNFRYAKYYKENNVEKRTLIKVFGIRFDILVFGTGGKFDIIQLVVYIGSTLSYFGLAAVFIDFLIDTYSSNCCRSHIYPWCKCCQPCVVNEYYYRKKCESIVEPKPTLKYVSFVDESHIRMVNQQLLGRSLQDVKGQEVPRPAMDFTDLSRLPLALHDTPPIPGQPEEIQLLRKEATPRSRDSPVWCQCGSCLPSQLPESHRCLEELCCRKKPGACITTSELFRKLVLSRHVLQFLLLYQEPLLALDVDSTNSRLRHCAYRCYATWRFGSQDMADFANLPSCCRWRIRKEFPKSEGQYSGFKSPY

SEQ ID NO: 60476 - protein, 275 aa, Homo sapiens
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGIQTGRCVVYEGNQKTCEVSAWCPIEAVEEAPRPALLNSAENFTVLIKNNIDFPGHNYTTYAKYYKENNVEKRTLIKVFGIRFDILVFGTGGKFDIIQLVVYIGSTLSYFGLVRDSLFHALGKWFGEGSD

SEQ ID NO: 60477 - protein, 505 aa, Homo sapiens
MTPGDHSWGNSFFVMTNFLKTEGQEQRLCPEYPTRRTLCSSDRGCKKGWMDPQSKGIQTGRCVVYEGNQKTCEVSAWCPIEAVEEAPRPALLNSAENFTVLIKNNIDFPGHNYTTRNILPGLNITCTFHKTQNPQCPIFRLGDIFRETGDNFSDVAIQGGIMGIEIYWDCNLDRWFHHCRPKYSFRRLDDKTTNVSLYPGYNFRYAKYYKENNVEKRTLIKVFGIRFDILVFGTGGKFDIIQLVVYIGSTLSYFGLAAVFIDFLIDTYSSNCCRSHIYPWCKCCQPCVVNEYYYRKKCESIVEPKPTLKYVSFVDESHIRMVNQQLLGRSLQDVKGQEVPRPAMDFTDLSRLPLALHDTPPIPGQPEEIQLLRKEATPRSRDSPVWCQCGSCLPSQLPESHRCLEELCCRKKPGACITTSELFRKLVLSRHVLQFLLLYQEPLLALDVDSTNSRLRHCAYRCYATWRFGSQDMADFANLPSCCRWRIRKEFPKSEGQYSGFKSPY

SEQ ID NO: 60478 - protein, 128 aa, Homo sapiens
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEEFRPEGV

SEQ ID NO: 60479 - protein, 306 aa, Homo sapiens
MWQFRYAKYYKENNVEKRTLIKVFGIRFDILVFGTGGKFDIIQLVVYIGSTLSYFGLAAVFIDFLIDTYSSNCCRSHIYPWCKCCQPCVVNEYYYRKKCESIVEPKPTLKYVSFVDESHIRMVNQQLLGRSLQDVKGQEVPRPAMDFTDLSRLPLALHDTPPIPGQPEEIQLLRKEATPRSRDSPVWCQCGSCLPSQLPESHRCLEELCCRKKPGACITTSELFRKLVLSRHVLQFLLLYQEPLLALDVDSTNSRLRHCAYRCYATWRFGSQDMADFANLPSCCRWRIRKEFPKSEGQYSGFKSPY

SEQ ID NO: 60480 - protein, 128 aa, Homo sapiens; identical to SEQ ID NO: 60478

SEQ ID NO: 60481 - protein, 595 aa, Homo sapiens
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGIQTGRCVVYEGNQKTCEVSAWCPIEAVEEAPRPALLNSAENFTVLIKNNIDFPGHNYTTRNILPGLNITCTFHKTQNPQCPIFRLGDIFRETGDNFSDVAIQGGIMGIEIYWDCNLDRWFHHCRPKYSFRRLDDKTTNVSLYPGYNFRYAKYYKENNVEKRTLIKVFGIRFDILVFGTGGKFDIIQLVVYIGSTLSYFGLAAVFIDFLIDTYSSNCCRSHIYPWCKCCQPCVVNEYYYRKKCESIVEPKPTLKYVSFVDESHIRMVNQQLLGRSLQDVKGQEVPRPAMDFTDLSRLPLALHDTPPIPGQPEEIQLLRKEATPRSRDSPVWCQCGSCLPSQLPESHRCLEELCCRKKPGACITTSELFRKLVLSRHVLQFLLLYQEPLLALDVDSTNSRLRHCAYRCYATWRFGSQDMADFANLPSCCRWRIRKEFPKSEGQYSGFKSPY

SEQ ID NO: 60482 - protein, 373 aa, Homo sapiens
MTEVLWPAVPNGTDAAFLAGPGSSWGNSTVASTAAVSSSFKCALTKTGFQFYYLPAVYILVFIIGFLGNSVAIWMFVFHMKPWSGISVYMFNLALADFLYVLTLPALIFYYFNKTDWIFGDAMCKLQRFIFHVNLYGSILFLTCISAHRYSGVVYPLKSLGRLKKKNAICISVLVWLIVVVAISPILFYSGTGVRKNKTITCYDTTSDEYLRSYFIYSMCTTVAMFCVPLVLILGCYGLIVRALIYKDLDNSPLRRKSIYLVIIVLTVFAVSYIPFHVMKTMNLRARLDFQTPAMCAFNDRVYATYQVTRGLASLNSCVDPILYFLAGDTFRRRLSRATRKASRRSEANLQSKSEDMTLNILPEFKQNGDTSL

SEQ ID NO: 60483 - protein, 374 aa, Homo sapiens
MAANVSGAKSCPANFLAAADDKLSGFQGDFLWPILVVEFLVAVASNGLALYRFSIRKQRPWHPAVVFSVQLAVSDLLCALTLPPLAAYLYPPKHWRYGEAACRLERFLFTCNLLGSVIFITCISLNRYLGIVHPFFARSHLRPKHAWAVSAAGWVLAALLAMPTLSFSHLKRPQQGAGNCSVARPEACIKCLGTADHGLAAYRAYSLVLAGLGCGLPLLLTLAAYGALGRAVLRSPGMTVAEKLRVAALVASGVALYASSYVPYHIMRVLNVDARRRWSTRCPSFADIAQATAALELGPYVGYQVMRGLMPLAFCVHPLLYMAAVPSLGCCCRHCPGYRDSWNPEDAKSTGQALPLNATAAPKPSEPQSRELSQ

SEQ ID NO: 60484 - protein, 342 aa, Homo sapiens
MQAVDNLTSAPGNTSLCTRDYKITQVLFPLLYTVLFFVGLITNGLAMRIFFQIRSKSNFIIFLKNTVISDLLMILTFPFKILSDAKLGTGPLRTFVCQVTSVIFYFTMYISISFLGLITIDRYQKTTRPFKTSNPKNLLGAKILSVVIWAFMFLLSLPNMILTNRQPRDKNVKKCSFLKSEFGLVWHEIVNYICQVIFWINFLIVIVCYTLITKELYRSYVRTRGVGKVPRKKVNVKVFIIIAVFFICFVPFHFARIPYTLSQTRDVFDCTAENTLFYVKESTLWLTSLNACLDPFIYFFLCKSFRNSLISMLKCPNSATSLSQDNRKKEQDGGDPNEETPM

SEQ ID NO: 60485 - protein, 245 aa, Homo sapiens
MQAVDNLTSAPGNTSLCTRDYKITQVLFPLLYTVLFFVGLITNGLAMRIFFQIRSKSNFIIFLKNTVISDLLMILTFPFKILSDAKLGTGPLRTFVCQVIFWINFLIVIVCYTLITKELYRSYVRTRGVGKVPRKKVNVKVFIIIAVFFICFVPFHFARIPYTLSQTRDVFDCTAENTLFYVKESTLWLTSLNACLDPFIYFFLCKSFRNSLISMLKCPNSATSLSQDNRKKEQDGGDPNEETPM

SEQ ID NO: 60486 - protein, 377 aa, Homo sapiens
MAADLGPWNDTINGTWDGDELGYRCRFNEDFKYVLLPVSYGVVCVPGLCLNAVALYIFLCRLKTWNASTTYMFHLAVSDALYAASLPLLVYYYARGDHWPFSTVLCKLVRFLFYTNLYCSILFLTCISVHRCLGVLRPLRSLRWGRARYARRVAGAVWVLVLACQAPVLYFVTTSARGGRVTCHDTSAPELFSRFVAYSSVMLGLLFAVPFAVILVCYVLMARRLLKPAYGTSGGLPRAKRKSVRTIAVVLAVFALCFLPFHVTRTLYYSFRSLDLSCHTLNAINMAYKVTRPLASANSCLDPVLYFLAGQRLVRFARDAKPPTGPSPATPARRRLGLRRSDRTDMQRIEDVLGSSEDSRRTESTPAGSENTKDIRL

SEQ ID NO: 60487 - protein, 377 aa, Homo sapiens; identical to SEQ ID NO: 60486

SEQ ID NO: 60488 - protein, 377 aa, Homo sapiens; identical to SEQ ID NO: 60486

SEQ ID NO: 60489 - protein, 359 aa, Homo sapiens
MQVPNSTGPDNATLQMLRNPAIAVALPVVYSLVAAVSIPGNLFSLWVLCRRMGPRSPSVIFMINLSVTDLMLASVLPFQIYYHCNRHHWVFGVLLCNVVTVAFYANMYSSILTMTCISVERFLGVLYPLSSKRWRRRRYAVAACAGTWLLLLTALSPLARTDLTYPVHALGIITCFDVLKWTMLPSVAMWAVFLFTIFILLFLIPFVITVACYTATILKLLRTEEAHGREQRRRAVGLAAVVLLAFVTCFAPNNFVLLAHIVSRLFYGKSYYHVYKLTLCLSCLNNCLDPFVYYFASREFQLRLREYLGCRRVPRDTLDTRRESLFSARTTSVRSEAGAHPEGMEGATRPGLQRQESVF

SEQ ID NO: 60490 - protein, 62 aa, Homo sapiens
MSERQGAGATNGKDKTSGENDGQKKVQEEFDIDMDAPETERAAVAIQSQFRKFQKKKAGSQS

SEQ ID NO: 60491 - protein, 637 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVKVSHLL

SEQ ID NO: 60492 - protein, 709 aa, Homo sapiens
MASNERDAISWYQKKIGAYDQQIWEKSIEQTQIKGLKNKPKKMGHIKPDLIDVDLIRVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRLWKIKS

SEQ ID NO: 60493 - protein, 717 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRIWKHSS

SEQ ID NO: 60494 - protein, 717 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRLWKIKS

SEQ ID NO: 60495 - protein, 709 aa, Homo sapiens; identical to SEQ ID NO: 60492

SEQ ID NO: 60496 - protein, 762 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRLWKIKS

SEQ ID NO: 60497 - protein, 762 aa, Homo sapiens; identical to SEQ ID NO: 60496

SEQ ID NO: 60498 - protein, 331 aa, Homo sapiens
  MOD_RES (1)..(1): Any amino acid
XQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQVSGEIRKIFYLFLYMIFH

SEQ ID NO: 60499 - protein, 105 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLL

SEQ ID NO: 60500 - protein, 233 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRRLLGVWVMGCLMTCQVKKMVKHGHR

SEQ ID NO: 60501 - protein, 919 aa, Homo sapiens [sequence omitted]

SEQ ID NO: 60502 - protein, 561 aa, Homo sapiens
MAFMEKPPAGKVLLDDTVPLTAAIEASQSLQSHTIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGISALPPPPPPPPPPAAPLPPASTEAPAQLSSQAVNGMSRGALLSSIQNFQKGTLRKAKTCDHSAPKIG

SEQ ID NO: 60503 - protein, 578 aa, Homo sapiens
MAFMEKPPAGKVLLDDTVPLTAAIEASQSLQSHTEYIIRVQRGISVENSWQIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGISALPPPPPPPPPPAAPLPPASTEAPAQLSSQAVNGMSRGALLSSIQNFQKGTLRKAKTCDHSAPKIG

SEQ ID NO: 60504 - protein, 545 aa, Homo sapiens
MAFMEKPPAGKVLLDDTVPLTAAIEASQSLQSHTIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGISALPPPPPPPPPPAAPLPPASTEAPAQLSSQAVNGMSRGALLSSIQNFQKGTLRKAKTCDHSAPKIG

SEQ ID NO: 60505 - protein, 515 aa, Homo sapiens
MAFMEKPPAGKVLLDDTVPLTAAIEASQSLQSHTEYIIRVQRGISVENSWQIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSVEHAPF

SEQ ID NO: 60506 - protein, 441 aa, Homo sapiens
MFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGISALPPPPPPPPPPAAPLPPASTEAPAQLSSQAVNGMSRGALLSSIQNFQKGTLRKAKTCDHSAPKIG

SEQ ID NO: 60507 - protein, 334 aa, Homo sapiens
MFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKKDFSSKEVKTICS

SEQ ID NO: 60508 - protein, 369 aa, Homo sapiens
MKSPEKKRRKSNTQGPAYSHLTEFAPPPTPMVDHLVASNPFEDDFGAPKVGVAAPPFLGSPVPFGGFRVQGGMAGQVPPGYSTGGGGGPQPLRRQPPPFPPNPMGPAFNMPPQGPGYPPPGNMNFPSQPFNQPLGQNFSPPSGQMMPGPVGGFGPMISPTMGQPPRAELGPPSLSQRFAQPGAPFGPSPLQRPGQGLPSLPPNTSPFPGPDPGFPGPGGEDGGKPLNPPASTAFPQEPHSGSPAAAVNGNQPSFPPNSSGRGGGTPDANSLAPPGKAGGGSGPQPPPGLVYPCGACRSEVNDDQDAILCEASCQKWFHRECTGMTESAYGLLTTEASAVWACDLCLKTKEIQSVYIREGMGQLVAANDG

SEQ ID NO: 60509 - protein, 406 aa, Homo sapiens
MAASAPPPPDKLEGGGGPAPPPAPPSTGRKQGKAGLQMKSPEKKRRKSNTQGPAYSHLTEFAPPPTPMVDHLVASNPFEDDFGAPKVGVAAPPFLGSPVPFGGFRVQGGMAGQVPPGYSTGGGGGPQPLRRQPPPFPPNPMGPAFNMPPQGPGYPPPGNMNFPSQPFNQPLGQNFSPPSGQMMPGPVGGFGPMISPTMGQPPRAELGPPSLSQRFAQPGAPFGPSPLQRPGQGLPSLPPNTSPFPGPDPGFPGPGGEDGGKPLNPPASTAFPQEPHSGSPAAAVNGNQPSFPPNSSGRGGGTPDANSLAPPGKAGGGSGPQPPPGLVYPCGACRSEVNDDQDAILCEASCQKWFHRECTGMTESAYGLLTTEASAVWACDLCLKTKEIQSVYIREGMGQLVAANDG

SEQ ID NO: 60510 - protein, 312 aa, Homo sapiens
MEEECRVLSIQSHVIRGYVGNRAATFPLQVLGFEIDAVNSVQFSNHTGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 60511 - protein, 284 aa, Homo sapiens
MEEECRVLSIQSHVIRGYVGNRAATFPLQVLGFEIDAVNSVQFSNHTGYAHWKGQVLNSDELQELYEGLRLNNMNKYDYVLTVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 60512 - protein, 773 aa, Homo sapiens
MGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 60513 - protein, 788 aa, Homo sapiens
MDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 60514 - protein, 697 aa, Homo sapiens
MGKNLKEAVKMLEDSQRRTEEENGKKLISGDIPGPLQGRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 60515 - protein, 760 aa, Homo sapiens
MDASLEKIADPTLAEMGKNLKEAVKMLEDSQRTEEENGKKLISGDIPGPLQGRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 60516 - protein, 429 aa, Homo sapiens
LSSTLRRIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWVRMAVTPLSFQVPVHHHPTCW

SEQ ID NO: 60517 - protein, 498 aa, Homo sapiens
MDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAGWSHCGTTTRYDCVRSRLTTRLPGSTGEQAPP

SEQ ID NO: 60518 - protein, 204 aa, Homo sapiens
MTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAGWSHCGTTTRYDCVRSRLTTRLPGSTGEQAPP

SEQ ID NO: 60519 - protein, 261 aa, Homo sapiens
MTCWLRGVTATFGRPAEWPGYLSHLCGRSAAMDLGPMRKSYRGDREAFEETHLTSLDPVKQFAAWFEEAVQCPDIGEANAMCLATCTRDGKPSARMLLLKGFGKDGFRFFTNFESRKGKELDSNPFASLVFYWEPLNRQVRVEGPVKKLPEEEAECYFHSRPKSSQIGAVVSHQSSVIPDREYLRKKNEELEQLYQDQEVPKPKSWGGYVLYPQVMEFWQGQTNRLHDRIVFRRGLPTGDSPLGPMTHRGEEDWLYERLAP

SEQ ID NO: 60520 - protein, 218 aa, Homo sapiens
MTCWLRGVTATFGRPAEWPGYLSHLCGRSAAMDLGPMRKSYRGDREAFEETHLTSLDPVKQFAAWFEEAVQCPDIGEANAMCLATCTRDGKPSARMLLLKGFGKDGFRFFTNFESRKGKELDSNPFASLVFYWEPLNRQYLRKKNEELEQLYQDQEVPKPKSWGGYVLYPQVMEFWQGQTNRLHDRIVFRRGLPTGDSPLGPMTHRGEEDWLYERLAP

SEQ ID NO: 60521 - protein, 166 aa, Homo sapiens
MLLLKGFGKDGFRFFTNFESRKGKELDSNPFASLVFYWEPLNRQVRVEGPVKKLPEEEAECYFHSRPKSSQIGAVVSHQSSVIPDREYLRKKNEELEQLYQDQEVPKPKSWGGYVLYPQVMEFWQGQTNRLHDRIVFRRGLPTGDSPLGPMTHRGEEDWLYERLAP

SEQ ID NO: 60522 - protein, 243 aa, Homo sapiens
MTCWLRGVTATFGRPAEWPGYLSHLCGRSAAMDLGPMRKSYRGDREAFEETHLTSLDPVKQFAAWFEEAVQCPDIGEANAMCLATCTRDGKPSARMLLLKGFGKDGFRFFTNFESRKGKELVRVEGPVKKLPEEEAECYFHSRPKSSQIGAVVSHQSSVIPDREYLRKKNEELEQLYQDQEVPKPKSWGGYVLYPQVMEFWQGQTNRLHDRIVFRRGLPTGDSPLGPMTHRGEEDWLYERLAP

SEQ ID NO: 60523 - protein, 365 aa, Homo sapiens
MASTESSLLRSLGLSPGPGSSEVELDCWFDEDFKFILLPVSYAVVFVLGLGLNAPTLWLFIFRLRPWDATATYMFHLALSDTLYVLSLPTLIYYYAAHNHWPFGTEICKFVRFLFYWNLYCSVLFLTCISVHRYLGICHPLRALRWGRPRLAGLLCLAVWLVVAGCLVPNLFFVTTSNKGTTVLCHDTTRPEEFDHYVHFSSAVMGLLFGVPCLVTLVCYGLMARRLYQPLPGSAQSSSRLRSLRTIAVVLTVFAVCFVPFHITRTIYYLARLLEADCRVLNIVNVVYKVTRPLASANSCLDPVLYLLTGDKYRRQLRQLCGGGKPQPRTAASSLALVSLPEDSSCRWAATPQDSSCSTPRADRL

SEQ ID NO: 60524 - protein, 328 aa, Homo sapiens
MEWDNGTGQALGLPPTTCVYRENFKQLLLPPVYSAVLAAGLPLNICVITQICTSRRALTRTAVYTLNLALADLLYACSLPLLIYNYAQGDHWPFGDFACRLVRFLFYANLHGSILFLTCISFQRYLGICHPLAPWHKRGGRRAAWLVCVAVWLAVTTQCLPTAIFAATGIQRNRTVCYDLSPPALATHYMPYGMALTVIGFLLPFAALLACYCLLACRLCRQDGPAEPVAQERRGKAARMAVVVAAAFAISFLPFHITKTAYLAVRSTPGVPCTVLEAFAAAYKGTRPFASANSVLDPILFYFTQKKFRRRPHELLQKLTAKWQRQGR

SEQ ID NO: 60525 - protein, 328 aa, Homo sapiens; identical to SEQ ID NO: 60524

SEQ ID NO: 60526 - protein, 328 aa, Homo sapiens; identical to SEQ ID NO: 60524

SEQ ID NO: 60527 - protein, 328 aa, Homo sapiens; identical to SEQ ID NO: 60524

SEQ ID NO: 60528 - protein, 245 aa, Homo sapiens
MEWDNGTGQALGLPPTTCVYRENFKQLLLPPVYSAVLAAGLPLNICVITQICTSRRALTRTAVYTLNLALADLLYACSLPLLIYNYAQGDHWPFGDFACRLVRFLFYANLHGSILFLTCISFQRYLGICHPLAPWHKRGGRRAAWLVCVAVWLAVTTQCLPTAIFAATGIQRNRTVCYDLSPPALATHYMPYGMALTVIGFLLPFAALLACYCLLACRLCRQDGPAEPVAQERRGKAARMAVVVA

SEQ ID NO: 60529 - protein, 328 aa, Homo sapiens; identical to SEQ ID NO: 60524

SEQ ID NO: 60530 - protein, 328 aa, Homo sapiens; identical to SEQ ID NO: 60524

SEQ ID NO: 60531 - protein, 328 aa, Homo sapiens; identical to SEQ ID NO: 60524

SEQ ID NO: 60532 - protein, 328 aa, Homo sapiens; identical to SEQ ID NO: 60524

SEQ ID NO: 60533 - protein, 128 aa, Homo sapiens
MEWDNGTGQALGLPPTTCVYRENFKQLLLPPVYSAVLAAGLPLNICVITQICTSRRALTRTAVYTLNLALADLLYACSLPLLIYNYAQGDHWPFGDFACRLVRFLFYANLHGSILFLTCISFQRYLGI

SEQ ID NO: 60534 - protein, 245 aa, Homo sapiens
MANNYKKIVLLKGLEVINDYHFRIVKSLLSNDLKLNPKMKEEYDKIQIADLMEEKFPGDAGLGKLIEFFKEIPTLGDLAETLKREKLKVANKIESIPVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTEAYLMNLTLSLTAGSFLSCAVWGRDRELRNLELSATDSLSTAPIYYTPIPFAH

SEQ ID NO: 60535 - protein, 483 aa, Homo sapiens
MANNYKKIVLLKGLEVINDYHFRIVKSLLSNDLKLNPKMKEEYDKIQIADLMEEKFPGDAGLGKLIEFFKEIPTLGDLAETLKREKLKVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTESLKPLANRHATASKNIFREDPIIAMVLNATKVFKYESSENEQRRMFHATVATQTQFFHVKVLNINLKRKFIKKRIIIISNYSKRNSLLEVNEASSVSEAGPDQTFEVPKDIIRRAKKIPKINILHKQTSGYIVYGLFMLHTKIVNRKTTIYEIQDKTGSMAVVGKGECHNIPCEKGDKLRLFCFRLRKRENMSKLMSEMHSFIQIQKNTNQRSHDSRSMALPQEQSQHPKPSEASTTLPESHLKTPQMPPTTPSSSSFTKKDETHPGAQSSPANFRITSPTVAPPLSSDTSTNRHPAVP

SEQ ID NO: 60536 - protein, 492 aa, Homo sapiens
MANNYKKIVLLKGLEVINDYHFRIVKSLLSNDLKLNPKMKEEYDKIQIADLMEEKFPGDAGLGKLIEFFKEIPTLGDLAETLKREKLKVANKIESIPVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTESLKPLANRHATASKNIFREDPIIAMVLNATKVFKYESSENEQRRMFHATVATQTQFFHVKVLNINLKRKFIKKRIIIISNYSKRNSLLEVNEASSVSEAGPDQTFEVPKDIIRRAKKIPKINILHKQTSGYIVYGLFMLHTKIVNRKTTIYEIQDKTGSMAVVGKGECHNIPCEKGDKLRLFCFRLRKRENMSKLMSEMHSFIQIQKNTNQRSHDSRSMALPQEQSQHPKPSEASTTLPESHLKTPQMPPTTPSSSSFTKKDETHPGAQSSPANFRITSPTVAPPLSSDTSTNRHPAVP

SEQ ID NO: 60537 - protein, 452 aa, Homo sapiens
MANNYKKIVLLKGLEVINDYHFRIVKSLLSNDLKLNPKMKEEYDKIQIADLMEEKFPGDAGLGKLIEFFKEIPTLGDLAETLKREKLKVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTESLKPLANRHATASKNIFREDPIIAMVLNATKVFKYESSENEQRRMFHATVATQTQFFHVKVLNINLKRKFIKKRIIIISNYSKRNSLLEVNEASSVSEAGPDQTFEVPKDIIRRAKKIPKINILHKQTSGYIVYGLFMLHTKIVNRKTTIYEIQDKTGSMAVVGKGECHNIPCEKGDKLRLFCFRLRKRENMSKLMSEMHSFIQIQKNTNQRSHDSRSMALPQEQSQHPKPSEASTTLPESHLKTPQMPPTTPSSSSFTKVTKDKDIK

SEQ ID NO: 60538 - protein, 461 aa, Homo sapiens
MANNYKKIVLLKGLEVINDYHFRIVKSLLSNDLKLNPKMKEEYDKIQIADLMEEKFPGDAGLGKLIEFFKEIPTLGDLAETLKREKLKVANKIESIPVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTESLKPLANRHATASKNIFREDPIIAMVLNATKVFKYESSENEQRRMFHATVATQTQFFHVKVLNINLKRKFIKKRIIIISNYSKRNSLLEVNEASSVSEAGPDQTFEVPKDIIRRAKKIPKINILHKQTSGYIVYGLFMLHTKIVNRKTTIYEIQDKTGSMAVVGKGECHNIPCEKGDKLRLFCFRLRKRENMSKLMSEMHSFIQIQKNTNQRSHDSRSMALPQEQSQHPKPSEASTTLPESHLKTPQMPPTTPSSSSFTKVTKDKDIK

SEQ ID NO: 60539 - protein, 150 aa, Homo sapiens
MANNYKKIVLLKGLEVINDYHFRIVKSLLSNDLKLNPKMKEEYDKIQIADLMEEKFPGDAGLGKLIEFFKEIPTLGDLAETLKREKLKVANKIESIPVKGIIPSKKTKQKEVYPATPACTPSNRLTAKGAEETLGPQKRKKPSEEETGTK

SEQ ID NO: 60540 - protein, 132 aa, Homo sapiens
MATTVTLEKCGHNKGYKGLDNCRFCPGSQCCVEDGPESIDSIIDMDAVCKRVTTLGLDVSVTISQDAGRYLCDFTYYTSLYQSHGRSAFVHVPPLGKPYNADQLGRALRAIIEEMLDLLEQSEGKINYCHKH

SEQ ID NO: 60541 - protein, 209 aa, Homo sapiens
MEQPRKAVVVTGFGPFGEHTVNASWIAVQELEKLGLGDSVDLHVYEIPVEYQTVQRLIPALWEKHSPQLVVHVGVSGMATTVTLEKCGHNKGYKGLDNCRFCPGSQCCVEDGPESIDSIIDMDAVCKRVTTLGLDVSVTISQDAGRYLCDFTYYTSLYQSHGRSAFVHVPPLGKPYNADQLGRALRAIIEEMLDLLEQSEGKINYCHKH

SEQ ID NO: 60542 - protein, 202 aa, Homo sapiens
MKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHGLRNIPVYTINRIVILPSLDRSQTSSLSYLPAHQDSCVPLDAALHVVLYFCSLLGLQSYLSCF

SEQ ID NO: 60543 - protein, 334 aa, Homo sapiens
MSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 60544 - protein, 305 aa, Homo sapiens
MSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 60545 - protein, 168 aa, Homo sapiens
MSALLRLLRTGAPAAACLRLGTSAGTGSRRAMALYHTEERGQPCSQNYRLFFNIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 60546 - protein, 349 aa, Homo sapiens
MSALLRLLRTGAPAAACLRLGTSAGTGSRRAMALYHTEERGQPCSQNYRLFFKNVTGHYISPFHDIPLKVNSKEDTEAQGIFIDLSKIWENGIPMKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 60547 - protein, 316 aa, Homo sapiens
MSALLRLLRTGAPAAACLRLGTSAGTGSRRAMALYHTEERGQPCSQNYRLFFKNVTGHYISPFHDIPLKVNSKEENGIPMKKARNDEYEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 60548 - protein, 232 aa, Homo sapiens
MSALLRLLRTGAPAAACLRLGTSAGTGSRRAMALYHTEERGQPCSQNYRLFFKNVTGHYISPFHDIPLKVNSKEILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 60549 - protein, 319 aa, Homo sapiens
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMADQEQVSPAAIKKTILDKVKLDSPAGTALSPSGHTKLLPRSLAPAGKD

SEQ ID NO: 60550 - protein, 316 aa, Homo sapiens
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMADQEQVSPAAIKKTILDKDHLPLELGSPEGLHPLLLQYQLARAPS

SEQ ID NO: 60551 - protein, 346 aa, Homo sapiens
MVGGGRRVGRDEPVPSVGALGQGSPDSMSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMADQEQVSPAAIKKTILDKVKLDSPAGTALSPSGHTKLLPRSLAPAGKD

SEQ ID NO: 60552 - protein, 272 aa, Homo sapiens
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGGCQDAAALRTAPRPAQGQRQLSWWGHHPCLACAGEWGLPLPAHQRCGGLLHPHTGAAVHG

SEQ ID NO: 60553 - protein, 240 aa, Homo sapiens
MSVGFIGAGQLAFALAKGFTAAGVLAAHKIMASSPDMDLATVSALRKMGVKLTPHNKETVQHSDVLFLAVKPHIISIEKLSAFRPAPRVIRCMTNTPVVVREGATVYATGTHAQVEDGRLMEQLLSSVGFCTEVEEDLIDAVTGLSGSGPAYGAAKMLLHSEQHPGQLKDNVSSPGGATIHALHVLESGGFRSLLINAVEASCIRTRWAPALPASLVSSPCMAEASLTHICSFTHSADTY

SEQ ID NO: 60554 - protein, 529 aa, Homo sapiens
MLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKVRRHQAQPLAAALGRPCGQEARRPQAAVTAPTGPGSPTLVRVPPAARVLSSRLGGPSQTTPETSTEVSPTILL

SEQ ID NO: 60555 - protein, 1178 aa, Homo sapiens
MLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 60556 - protein, 1178 aa, Homo sapiens; identical to SEQ ID NO: 60555

SEQ ID NO: 60557 - protein, 1178 aa, Homo sapiens; identical to SEQ ID NO: 60555

SEQ ID NO: 60558 - protein, 204 aa, Homo sapiens
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQFLLPLTQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDG

SEQ ID NO: 60559 - protein, 109 aa, Homo sapiens
MELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 60560 - protein, 180 aa, Homo sapiens
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVVKDEDCVLL

SEQ ID NO: 60561 - protein, 428 aa, Homo sapiens
MRKMLAAVSRVLSGASQKPRHGLATLPSLVSISRLKQSSHLGLPKCWDYSHSLKTRQASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 60562 - protein, 121 aa, Homo sapiens
MRKMLAAVSRVLSGASQKPFAGSPPPRHLTVGRKLSSRYEVTFESAQASRVLVASRNFANDATFEIKKCDLHRLEEGPPVTTVLTREDGLKYYRMMQTVRRMELKADQLYKQKIIRGFCHL

SEQ ID NO: 60563 - protein, 121 aa, Homo sapiens; identical to SEQ ID NO: 60562

SEQ ID NO: 60564 - protein, 390 aa, Homo sapiens
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 60565 - protein, 205 aa, Homo sapiens
MRKMLAAVSRVLSGASQKPRHGLATLPSLVSISRLKQSSHLGLPKCWDYSHSLKTRQASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIV

SEQ ID NO: 60566 - protein, 359 aa, Homo sapiens
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 60567 - protein, 42 aa, Homo sapiens
ANQWIKFKSVKGRRRRGYTFRGLPDSVLNLVKEEENPVNEIQ

SEQ ID NO: 60568 - protein, 397 aa, Homo sapiens
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQFLLPLTQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 60569 - protein, 388 aa, Homo sapiens
MLAAFISRVLRRVAQKSARRVLVASRNSSNDATFEIKKCDLYLLEEGPPVTTVLTRAEGLKYYRMMLTVRRMELKADQLYKQKFIRGFCHLCDGQEACCVGLEAGINPSDHVITSYRAHGVCYTRGLSVRSILAELTGRRGGCAKGKGGSMHMYTKNFYGGNGIVGAQGPLGAGIALACKYKGNDEICLTLYGDGAANQGQIAEAFNMAALWKLPCVFICENNLYGMGTSTERAAASPDYYKRGNFIPGLKVDGMDVLCVREATKFAANYCRSGKGPILMELQTYRYHGHSMSDPGVSYRTREEIQEVRSKRDPIIILQDRMVNSKLATVEELKEIGAEVRKEIDDAAQFATTDPEPHLEELGHHIYSSDSSFEVRGANPWIKFKSVS

SEQ ID NO: 60570 - protein, 359 aa, Homo sapiens
MAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 60571 - protein, 341 aa, Homo sapiens
MAAVSGLVRRPLREVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 60572 - protein, 341 aa, Homo sapiens
MAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 60573 - protein, 411 aa, Homo sapiens
MKAARFVLRSAGSLNGAGLVPREVEHFSRYSPSPLSMKQLLDFGSENACERTSFAFLRQELPVRLANILKEIDILPTQLVNTSSVQLVKSWYIQSLMDLVEFHEKSPDDQKALSDFVDTLIKVRNRHHNVVPTMAQGIIEYKDACTVDPVTNQNLQYFLDRFYMNRISTRMLMNQHILIFSDSQTGNPSHIGSIDPNCDVVAVVQDAFECSRMLCDQYYLSSPELKLTQVNGKFPDQPIHIVYVPSHLHHMLFELFKNAMRATVEHQENQPSLTPIEVIVVLGKEDLTIKISDRGGGVPLRIIDRLFSYTYSTAPTPVMDNSRNAPLAGFGYGLPISRLYAKYFQGDLNLYSLSGYGTDAIIYLKALSSESIEKLPVFNKSAFKHYQMSSEADDWCIPSREPKNLAKEVAM

SEQ ID NO: 60574 - protein, 375 aa, Homo sapiens
MKQLLDFGSENACERTSFAFLRQELPVRLANILKEIDILPTQLVNTSSVQLVKSWYIQSLMDLVEFHEKSPDDQKALSDFVDTLIKVRNRHHNVVPTMAQGIIEYKDACTVDPVTNQNLQYFLDRFYMNRISTRMLMNQHILIFSDSQTGNPSHIGSIDPNCDVVAVVQDAFECSRMLCDQYYLSSPELKLTQVNGKFPDQPIHIVYVPSHLHHMLFELFKNAMRATVEHQENQPSLTPIEVIVVLGKEDLTIKISDRGGGVPLRIIDRLFSYTYSTAPTPVMDNSRNAPLAGFGYGLPISRLYAKYFQGDLNLYSLSGYGTDAIIYLKALSSESIEKLPVFNKSAFKHYQMSSEADDWCIPSREPKNLAKEVAM

SEQ ID NO: 60575 - protein, 537 aa, Homo sapiens
MPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRSAATCLQTRGMLLGVFDGHAGCACSQAVSERLFYYIAVSLLPHETLLEIENAVESGRALLPILQWHKHPNDYFSKEASKLYFNSLRTYWQELIDLNTGESTDIDVKEALINAFKRLDNDISLEAQVGDPNSFLNYLVLRVAFSGATACVAHVDGVDLHVANTGDSRAMLGVQEEDGSWSAVTLSNDHNAQNERELERLKLEHPKSEAKSVVKQDRLLGLLMPFRAFGDVKFKWSIDLQKRVIESGPDQLNDNEYTKFIPPNYHTPPYLTAEPEVTYHRLRPQDKFLVLATDGLWETMHRQDVVRIVGEYLTGMHHQQPIAVGGYKVTLGQMHGLLTERRTKMSSVFEDQNAATHLIRHAVGNNEFGTVDHERLSKMLSLPEELARMYRDDITIIVVQFNSHVVGAYQNQE

SEQ ID NO: 60576 - protein, 562 aa, Homo sapiens
MCVCPGPRRIGIPVRSSSLPLFSDAMPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRSAATCLQTRGMLLGVFDGHAGCACSQAVSERLFYYIAVSLLPHETLLEIENAVESGRALLPILQWHKHPNDYFSKEASKLYFNSLRTYWQELIDLNTGESTDIDVKEALINAFKRLDNDISLEAQVGDPNSFLNYLVLRVAFSGATACVAHVDGVDLHVANTGDSRAMLGVQEEDGSWSAVTLSNDHNAQNERELERLKLEHPKSEAKSVVKQDRLLGLLMPFRAFGDVKFKWSIDLQKRVIESGPDQLNDNEYTKFIPPNYHTPPYLTAEPEVTYHRLRPQDKFLVLATDGLWETMHRQDVVRIVGEYLTGMHHQQPIAVGGYKVTLGQMHGLLTERRTKMSSVFEDQNAATHLIRHAVGNNEFGTVDHERLSKMLSLPEELARMYRDDITIIVVQFNSHVVGAYQNQE

SEQ ID NO: 60577 - protein, 537 aa, Homo sapiens; identical to SEQ ID NO: 60575

SEQ ID NO: 60578 - protein, 76 aa, Homo sapiens
MPAPTQLFFPLIRNCELSRIYGTACYCHHKHLCCSSSYIPQSRLRYTPHPAYATFCRPKENWWQYTQGRRYASTPQ

SEQ ID NO: 60579 - protein, 128 aa, Homo sapiens
MPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRS

SEQ ID NO: 60580 - protein, 232 aa, Homo sapiens
MPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRSAATCLQTRGMLLGVFDGHAGCACSQAVSERLFYYIAVSLLPHETLLEIENAVESGRALLPILQWHKHPNDYFSKEASKLYFNSLRTYWQELIDLNTGESTDIDV

SEQ ID NO: 60581 - protein, 72 aa, Homo sapiens
MPAPTQLFFPLIRNCELSRIYGTACYCHHKHLCCSSSYIPQSRLRYTPHPAYATFCRPKENWWQYTQGRRYA

SEQ ID NO: 60582 - protein, 537 aa, Homo sapiens; identical to SEQ ID NO: 60575

SEQ ID NO: 60583 - protein, 147 aa, Homo sapiens
MPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRSAATCLQTRGMLLGVFDGHA

SEQ ID NO: 60584 - protein, 488 aa, Homo sapiens
MADTFLEHLCLLDIDSEPVAARSTSIIATIGPASRSVERLKEMIKAGMNIARLNFSHGSHEYHAESIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 60585 - protein, 574 aa, Homo sapiens
MSIQENISSLQLRSWVSKSQRDLAKSILIGAPGGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 60586 - protein, 543 aa, Homo sapiens
MEGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 60587 - protein, 599 aa, Homo sapiens
MSIQENISSLQLRSWVSKSQRDLAKSILIGAPGVPLTTQQCGADPQRGRPREVCSGMEGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 60588 - protein, 531 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAMFHRKLFEELVRASSHSTDLMEAMAMGSVEASYKCLAAALIVLTESGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 60589 - protein, 366 aa, Homo sapiens
MSKPHSEAGTAFIQTQQLHAAMADTFLEHMCRLDIDSPPIKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAMFHRKLFEELVRASSHSTDLMEAMAMGSVEASYKCLAAALIVLTESGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 60590 - protein, 531 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 60591 - protein, 531 aa, Homo sapiens; identical to SEQ ID NO: 60588

SEQ ID NO: 60592 - protein, 458 aa, Homo sapiens
MSKPHSEAGTAFIQTQQLHAAMADTFLEHMCRLDIDSPPITARNTGIICTIGPASRSEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 60593 - protein, 516 aa, Homo sapiens
MSPEAQPQRTKGPQQPCRSPIVKPGLPSFRPSSCTQPWLTHSWSTCAAWTLIHHPSQPGTLASSVPLYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 60594 - protein, 403 aa, Homo sapiens
MAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 60595 - protein, 225 aa, Homo sapiens
MAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRPLGLVTGALLQVNPLAGPVHCSPSAAGQAEPLRHYPGWAGRRSPGHLP

SEQ ID NO: 60596 - protein, 698 aa, Homo sapiens
MAAAGAAVARSPGIGAGPALRARRSPPPRAARLPRLLVLLAAAAVGPGAGGAARLYRAGEDAVWVLDSGSVRGATANSSAAWLVQFYSSWCGHCIGYAPTWRALAGDVRDWASAIRVAALDCMEEKNQAVCHDYDIHFYPTFRYFKAFTKEFTTGENFKGPDRELRTVRQTMIDFLQNHTEGSRPPACPRLDPIQPSDVLSLLDNRGSHYVAIVFESNSSYLGREVILDLIPYESIVVTRALDGDKAFLEKLGVSSVPSCYLIYPNGSHGLINVVKPLRAFFSSYLKSLPDVRKKSLPLPEKPHKEENSEIVVWREFDKSKLYTVDLESGLHYLLRVELAAHKSLAGAELKTLKDFVTVLAKLFPGRPPVKKLLEMLQEWLASLPLDRIPYNAVLDLVNNKMRISGIFLTNHIKWVGCQGSRSELRGYPCSLWKLFHTLTVEASTHPDALVGTGFEDDPQAVLQTMRRYVHTFFGCKECGEHFEEMAKESMDSVKTPDQAILWLWKKHNMVNGRLAGHLSEDPRFPKLQWPTPDLCPACHEEIKGLASWDEGHVLTFLKQHYGRDNLLDTYSADQGDSSEGGTLARGEEEEKRLTPPEVSHGDRDTQSVRPPGALGPRPALPESLHHSLDGKLQSLDGPGAHKEVGGAAPFLGVDFSSLDMSLCVVLYVASSLFLMVMYFFFRVRSRRWKVKHHHPAV

SEQ ID NO: 60597 - protein, 315 aa, Homo sapiens
MEEKNQAVCHDYDIHFYPTFRYFKAFTKEFTTGENFKGPDRELRTVRQTMIDFLQNHTEGSRPPACPRLDPIHVKPLRAFFSSYLKSLPDVRKKSLPLPEKPHKEENSEIVVWREFDKSKLYTVDLESGLHYLLRVELAAHKSLAGAELKTLKDFVTVLAKLFPGRPPVKKLLEMLQEWLASLPLDRIPYNAVLDLVNNKMRISGIFLTNHIKWVGCQGSRSELRGYPCSLWKLFHTLTVEASTHPDALVGTGFEDDPQAVLQTMRRYVHTFFGCKECGEHFEEMAKESMDSVKTPDQAILWLWKKHNMVNGRLA

SEQ ID NO: 60598 - protein, 244 aa, Homo sapiens
MAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 60599 - protein, 152 aa, Homo sapiens
MGPPSLHSPTPSLGPLGALVLSSQHTSPDSCKSPWTLKAVRAARQAADFTLKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 60600 - protein, 297 aa, Homo sapiens
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLGGLVMVKDNHVVAAGGVEKAVRAARQAADFTLKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 60601 - protein, 165 aa, Homo sapiens
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLG

SEQ ID NO: 60602 - protein, 567 aa, Homo sapiens
MHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNFHCWDYRRFVATQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGSRMEILLLMVDDSPLIVEWRTPDGRNRPSHVWLCDLPAASLNDQLPQHTFRVIWTAGDVQKECVLLKGRQEGWCRDSTTDEQLFRCELSVEKSTVLQSELESCKELQELEPENKWCLLTIILLMRALDPLLYEKETLQYFQTLKAVDPMRATYLDDLRSKFLLENSVLKMEYAEVRVLHLAHKDLTVLCHLEQLLLVTHLDLSHNRLRTLPPALAALRCLEVLQASDNAIESLDGVTNLPRLQELLLCNNRLQQPAVLQPLASCPRLVLLNLQGNPLCQAVGILEQLAELLPSVSSVLT

SEQ ID NO: 60603 - protein, 567 aa, Homo sapiens; identical to SEQ ID NO: 60602

SEQ ID NO: 60604 - protein, 331 aa, Homo sapiens
MGTPQKDVIIKSDAPDTLLLEKHADYIASYGSKKDDYEYCMSEYLRMSGIYWGLTVMDLMGQLHRMNREEILAFIKSCQHECGGISASIGHDPHLLYTLSAVQILTLYDSINVIDVNKVVEYVKGLQKEDGSFAGDIWGEIDTRFSFCAVATLALLGKLDAINVEKAIEFVLSCMNFDGGFGCRPGSESHAGQIYCCTGFLAITSQLHQVNSDLLGWWLCERQLPSGGLNGRPEKLPDVCYSWWVLASLKIIGRLHWIDREKLRNFILACQDEETGGFADRPGDMVDPFHTLFGIAGLSLLGEEQIKPVNPVFCMPEEVLQRVNVQPELVS

SEQ ID NO: 60605 - protein, 320 aa, Homo sapiens
MGTPQKDVIIKSDAPDTLLLEKHADYIASYGSKKDDYEYCMSEYLRMSGIYWGLTVMDLMGQLHRMNREEILAFIKSCQHECGGISASIGHDPHLLYTLSAVQILTLYDSINVIDVNKVVEYVKGLQKEDGSFAGDIWGEIDTRFSFCAVATLALLGKLDAINVEKAIEFVLSCMNFDGGFGCRPGSESHAGQIYCCTGFLAITSQLHQVNSDLLGWWLCERQLPSGGLNGRPEKLPDVCYSWWVLASLKIIGRLHWIDREKLRNFILACQDEETGGFADRPGDMHFIYQNYPKKELSSNKETLTESLLPRLERSSTISA

SEQ ID NO: 60606 - protein, 152 aa, Homo sapiens
MGTPQKDVIIKSDAPDTLLLEKHADYIASYGSKKDDYEYCMSEYLRMSGIYWGLTVMDLMGQLHRMNREEILAFIKSCQHECGGISASIGHDPHLLYTLSAVQILTLYDSINVIDVNKVVEYVKGLQKEDGSFAGDIWGNVRFSPFYPKYQY

SEQ ID NO: 60607 - protein, 157 aa, Homo sapiens
MNFDGGFGCRPGSESHAGQIYCCTGFLAITSQLHQVNSDLLGWWLCERQLPSGGLNGRPEKLPDVCYSWWVLASLKIIGRLHWIDREKLRNFILACQDEETGGFADRPGDMVDPFHTLFGIAGLSLLGEEQIKPVNPVFCMPEEVLQRVNVQPELVS

SEQ ID NO: 60608 - protein, 491 aa, Homo sapiens; identical to SEQ ID NO: 58565

SEQ ID NO: 60609 - protein, 505 aa, Homo sapiens
MMASSYHEVVSRKKMSLKSERRGIHVDQSDLLCKKGCGYYGNPAWQGFCSKCWREEYHKARQKQIQEDWELAERLQREEEEAFASSQSSQGAQSLTFSKFEEKKTNEKTRKVTTVKKFFSASSRVGSKKEIQEAKAPSPSINRQTSIETDRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 60610 - protein, 45 aa, Homo sapiens
MSLKSERRGIHVDQSDLLCKKGCGYYGNPAWQGFCSKCWREEYHK

SEQ ID NO: 60611 - protein, 491 aa, Homo sapiens; identical to SEQ ID NO: 58565

SEQ ID NO: 60612 - protein, 123 aa, Homo sapiens
MEPAEQPSELVSAEGRNRKAVLCQRCGSRVLQPGTALFSRRQLFLPSMRKKPALSDGSNPDGDLLQEHWLVEDMFIFENVGFTKDVGNIKFLVCADCEIGPIGWHCLDDKNSFYVALERVSHE

SEQ ID NO: 60613 - protein, 401 aa, Homo sapiens
MEPRRAAPGVPGWGSREAAGSASAAELVYHLAGALGTELQDLARRFGPEAAAGLVPLVVRALELLEQAAVGPAPDSLQVSAQPAEQELRRLREENERLRRELRAGPQEERALLRQLKEVTDRQRDELRAHNRDLRQRGQETEALQEQLQRLLLVNAELRHKLAAMQTQLRAAQDRERERQQPGEAATPQAKERARGQAGRPGHQHGQEPEWATAGAGAPGNPEDPAEAAQQLGRPSEAGQCRFSREEFEQILQERNELKAKVFLLKEELAYFQRELLTDHRVPGLLLEAMKVAVRKQRKKIKAKMLGTPEEAESSEDEAGPWILLSDDKGDHPPPPESKIQSFFGLWYRGKAESSEDETSSPAPSKLGGEEEAQPQSPAPDPPCSALHEHLCLGASAAPEA

SEQ ID NO: 60614 - protein, 403 aa, Homo sapiens
MEEERGSALAAESALEKNVAELTVMDVYDIASLVGHEFERVIDQHGCEAIARLMPKVVRVLEILEVLVSRHHVAPELDELRLELDRLRLERMDRIEKERKHQKELELVEDVWRGEAQDLLSQIAQLQEENKQLMTNLSHKDVNFSEEEFQKHEGMSERERQVMKKLKEVVDKQRDEIRAKDRELGLKNEDVEALQQQQTRLMKINHDLRHRVTVVEAQGKALIEQKVELEADLQTKEQEMGSLRAELGKLRERLQGEHSQNGEEEPETEPVGEESISDAEKVAMDLKDPNRPRFTLQELRDVLHERNELKSKVFLLQEELAYYKSEEMEEENRIPQPPPIAHPRTSPQPESGIKRLFSFFSRDKKRLANTQRNVHIQESFGQWANTHRDDGYTEQGQEALQHL

SEQ ID NO: 60615 - protein, 211 aa, Homo sapiens
MEEPPVREEEEEEGEEDEERDEVGPEGALGKSPFQLTAEDVYDISYLLGRELMALGSDPRVTQLQFKVVRVLEMLEALVNEGSLALEELKMERDHLRKEVEGLRRQSPPASGEVNLGPNKMVVDLTDPNRPRFTLQELRDVLQERNKLKSQLLVVQEELQCYKSGLIPPREGPGGRREKDAVVTSAKNAGRNKEEKTIIKKLFFFRSGKQT

SEQ ID NO: 60616 - protein, 238 aa, Homo sapiens
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMVFDVQRKVTYRNLSTWYTELREFRPEIPCIVVANKIDDINVTQKSFNFAKKFSLPLYFVSAADGTNVVKVWLTAEVASKLFNDAIRLAVSYKQNSQDFMDEIFQELENFSLEQEEEDVPDQEQSSSIETPSEEAASPHS

SEQ ID NO: 60617 - protein, 165 aa, Homo sapiens
MAEDKTKPSELDQGKYDADDNVKIICLGDSAVGKSKLMERFLMDGFQPQQLSTYALTLYKHTATVDGKTILVADINVTQKSFNFAKKFSLPLYFVSAADGTNVVKLFNDAIRLAVSYKQNSQDFMDEIFQELENFSLEQEEEDVPDQEQSSSIETPSEEVASPHS

SEQ ID NO: 60618 - protein, 229 aa, Homo sapiens
MAEDKTKPSELDQGKYDADDNVKIICLGDSAVGKSKLMERFLMDGFQPQQLSTYALTLYKHTATVDGKTILVDFWDTAGQERFQSMHASYYHKAHACIMVFDIQRKVTYRNLSTWYTELREFRPEIPCIVVANKIDADINVTQKSFNFAKKFSLPLYFVSAADGTNVVKLFNDAIRLAVSYKQNSQDFMDEIFQELENFSLEQEEEDVPDQEQSSSIETPSEEVASPHS

SEQ ID NO: 60619 - protein, 228 aa, Homo sapiens
MAEDKTKPSELDQGKYDADDNVKIICLGDSAVGKSKLMERFLMDGFQPQQLSTYALTLYKHTATVDGKTILVDFWDTAGQERFQSMHASYYHKAHACIMVFDIQRKVTYRNLSTWYTELREFRPEIPCIVVANKIDDINVTQKSFNFAKKFSLPLYFVSAADGTNVVKLFNDAIRLAVSYKQNSQDFMDEIFQELENFSLEQEEEDVPDQEQSSSIETPSEEVASPHS

SEQ ID NO: 60620 - protein, 228 aa, Homo sapiens; identical to SEQ ID NO: 60619

SEQ ID NO: 60621 - protein, 238 aa, Homo sapiens
MAEDKTKPSELDQGKYDADDNVKIICLGDSAVGKSKLMERFLMDGFQPQQLSTYALTLYKHTATVDGKTILVDFWDTAGQERFQSMHASYYHKAHACIMVFDIQRKVTYRNLSTWYTELREFRPEIPCIVVANKIDDINVTQKSFNFAKKFSLPLYFVSAADGTNVVKVWLTAEVASKLFNDAIRLAVSYKQNSQDFMDEIFQELENFSLEQEEEDVPDQEQSSSIETPSEEVASPHS

SEQ ID NO: 60622 - protein, 114 aa, Homo sapiens
MAEDKTKPSELDQGKYDADDNVKIICLGDSAVGKSKLMERFLMDGFQPQQLSTYALTLYKHTATVDGKTILVDFWDTAGQERFQSMHASYYHKAHACIMVFDIQRKVTYRNLST

SEQ ID NO: 60623 - protein, 101 aa, Homo sapiens
MAEDKTKPSELDQGKYDADDNVKIICLGDSAVGKSKLMERFLMDGFQPQQLSTYALTLYKHTATVDGKTILVDFWDTAGQERFQSMHASYYHKAHACIMQT

SEQ ID NO: 60624 - protein, 229 aa, Homo sapiens
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMVFDVQRKVTYRNLSTWYTELREFRPEIPCIVVANKIDADINVTQKSFNFAKKFSLPLYFVSAADGTNVVKLFNDAIRLAVSYKQNSQDFMDEIFQELENFSLEQEEEDVPDQEQSSSIETPSEEAASPHS

SEQ ID NO: 60625 - protein, 229 aa, Homo sapiens; identical to SEQ ID NO: 60624

SEQ ID NO: 60626 - protein, 228 aa, Homo sapiens
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMVFDVQRKVTYRNLSTWYTELREFRPEIPCIVVANKIDDINVTQKSFNFAKKFSLPLYFVSAADGTNVVKLFNDAIRLAVSYKQNSQDFMDEIFQELENFSLEQEEEDVPDQEQSSSIETPSEEAASPHS

SEQ ID NO: 60627 - protein, 20 aa, Homo sapiens
MAEDKTKPSELDQGKYDADD

SEQ ID NO: 60628 - protein, 228 aa, Homo sapiens; identical to SEQ ID NO: 60626

SEQ ID NO: 60629 - protein, 200 aa, Homo sapiens
MAKKTYDLLFKLLLIGDSGVGKTCVLFRFSDDAFNTTFISTIGIDFKIKTVELQGKKIKLQIWDTAGQERFHTITTSYYRGAMGIMLVYDITNGKSFENISKWLRNIDEHANEDVERMLLGNKCDMDDKRVVPKGKGEQIAREHGIRFFETSAKANINIEKAFLTLAEDILRKTPVKEPNSENVDISSGGGVTGWKSKCC

SEQ ID NO: 60630 - protein, 649 aa, Homo sapiens
MSLMVSAGRGLGAVWSPTHVQVTVLQARGLRAKGPGGTSDAYAVIQVGKEKYATSVSERSLGAPVWREEATFELPSLLSSGPAAAATLQLTVLHRALLGLDKFLGRAEVDLRDLHRDQGRRKTQWYKLKSKPGKKDKERGEIEVDIQFMRNNMTASMFDLSMKDKSRNPFGKLKDKIKGKNKDSGSDTASAIIPSTTPSVDSDDESVVKDKKKKSKIKTLLSKSNLQKTPLSQSMSVLPTSKPEKVLLRPGDFQSQWDEDDNEDESSSASDVMSHKRTASTDLKQLNQVNFTLPKKEGLSFLGGLRSKNDVLSRSNVCINGNHVYLEQPEAKGEIKDSSPSSSPSPKGFRKKHLFSSTENLAAGSWKEPAEGGGLSSDRQLSESSTKDSLKSMTLPSYRPAPLVSGDLRENMAPANSEATKEAKESKKPESRRSSLLSLMTGKKDVAKGSEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNAMATKVANCSLGTATIISENLNNEVMMKKYSPSDPAFAYAQLTHDELIQLVLKQKETISKKEFQVRELEDYIDNLLVRVMEETPNILRIPTQVGKKAGKM

SEQ ID NO: 60631 - protein, 1283 aa, Homo sapiens [sequence omitted]

SEQ ID NO: 60632 - protein, 142 aa, Homo sapiens
MSLMVSAGRGLGAVWSPTHVQVTVLQARGLRAKGPGGTSDAYAVIQVGKEKYATSVSERSLGAPVWREEATFELPSLLSSGPAAAATLQLTVLHRALLGLDKFLGRAEVDLRDLHRDLGKSFFKTLKKRAWAIFLRLCLKKN

SEQ ID NO: 60633 - protein, 439 aa, Homo sapiens
MRNNMTASMFDLSMKDKSRNPFGKLKDKIKGKNKDSGSDTASAIIPSTTPSVDSDDESVVKDKKKKSKIKTLLSKSNLQKTPLSQSMSVLPTSKPEKVLLRPGDFQSQWDEDDNEDESSSASDVMSHKRTASTDLKQLNQVNFTLPKKEGLSFLGGLRSKNDVLSRSNVCINGNHVYLEQPEAKGEIKDSSPSSSPSPKGFRKKHLFSSTENLAAGSWKEPAEGGGLSSDRQLSESSTKDSLKSMTLPSYRPAPLVSGDLRENMAPANSEATKEAKESKKPESRRSSLLSLMTGKKDVAKGSEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNAMATKVANCSLGTATIISENLNNEVMMKVCPLRSWCVR

SEQ ID NO: 60634 - protein, 512 aa, Homo sapiens
MMLSEQAQKWFPTHVQVTVLQAKDLKPKGKSGTNDTYTIIQLGKEKYSTSVAEKTLEPVWKEEASFELPGLLIQGSPEKYILFLIVMHRSLVGLDKFLGQVAINLNDIFEDKQRRKTEWFRLESKQGKRIKNRGEIKVNIQFMRNNMTASMFDLSMKDKTRSPFAKLKDKMKGRKNDGTFSDTSSAIIPSTHMPDANSEFSSGEIQMKSKPKKPFLLGPQRLSSAHSMSDLSGSHMSSEKLKAGTIGQTHLLGHQLDSFGTVPESGSLKSPHRRTLSFDTSKMNQPDSIVDEGELCFGRQNDPFTNVTASLPQKFATLPRKKNPFEESSETWDSSMNLFSKPIEIRKENKREKREKVSLFERVTGKKDSRRSDKLNNGGSDSPCDLKSPNAFSENRQDYFDYESTNPFTAKFRASNIMPSSSFHMSPTSNEDLRKIPDSNPFDATAGYRSLTYEEVLQELVKHKELLRRKDTHIRELEDYIDNLLVRVMEETPSILRVPYEPSRKAGKFSNS

SEQ ID NO: 60635 - protein, 532 aa, Homo sapiens
MMLSEQAQKWFPTHVQVTVLQAKDLKPKGKSGTNDTYTIIQLGKEKYSTSVAEKTLEPVWKEEASFELPGLLIQGSPEKYILFLIVMHRSLVGLDKFLGQVAINLNDIFEDKQRRKTEWFRLESKQGKRIKNRGEIKVNIQFMRNNMTASMFDLSMKDKTRSPFAKLKDKMKGRKNDGTFSDTSSAIIPSTHMPDANSEFSSGEIQMKSKPKKPFLLGPQRLSSAHSMSDLSGSHMSSEKLKAGTIGQTHLLGHQLDSFGTVPESGSLKSPHRRTLSFDTSKMNQPDSIVDEGELCFGRQNDPFTNVTASLPQKFATLPRKKNPFEESSETWDSSMNLFSKPIEIRKENKREKREKVSLFERVTGKKDSRRSDKLNNGGSDSPCDLKSPNAFSENRQDYFDYESTNPFTAKFRASNIMPSSRNTLLTPAVAEWRGSLRWAELFHMSPTSNEDLRKIPDSNPFDATAGYRSLTYEEVLQELVKHKELLRRKDTHIRELEDYIDNLLVRVMEETPSILRVPYEPSRKAGKFSNS

SEQ ID NO: 60636 - protein, 756 aa, Homo sapiens
MASAPPASPPGSEPPGPDPEPGGPDGPGAAQLAPGPAELRLGAPVGGPDPQSPGLDEPAPGAAADGGARWSAGPAPGLEGGPRDPGPSAPPPRSGPRGQLASPDAPGPGPRSEAPLPELDPLFSWTEEPEECGPASCPESAPFRLQGSSSSHRARGEVDVFSPFPAPTAGELALEQGPGSPPQPSDLSQTHPLPSEPVGSQEDGPRLRAVFDALDGDGDGFVRIEDFIQFATVYGAEQVKDLTKYLDPSGLGVISFEDFYQGITAIRNGDPDGQCYGGVASAQDEEPLACPDEFDDFVTYEANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSPTKRLSSKKVARYLHQSGALTMEALEDPSPELMEGPEEDIADKVVFLERRVLELEKDTAATGEQHSRLRQENLQLVHRANALEEQLKEQELRACEMVLEETRRQKELLCKMEREKSIEIENLQTRLQQLDEENSELRSCTPCLKANIERLEEEKQKLLDEIESLTLRLSEEQENKRRMGDRLSHERHQFQRDKEATQELIEDLRKQLEHLQLLKLEAEQRRGRSSSMGLQEYHSRARESELEQEVRRLKQDNRNLKEQNEELNGQIITLSIQGAKSLFSTAFSESLAAEISSVSRDELMEAIQKQEEINFRLQDYIDRIIVAIMETNPSILEVK

SEQ ID NO: 60637 - protein, 460 aa, Homo sapiens
MSLLRANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSPTKRLSSKKVARYLHQSGALTMEALEDPSPELMEGPEEDIADKVVFLERRVLELEKDTAATGEQHSRLRQENLQLVHRANALEEQLKEQELRACEMVLEETRRQKELLCKMEREKSIEIENLQTRLQQLDEENSELRSCTPCLKANIERLEEEKQKLLDEIESLTLRLSEEQENKRRMGDRLSHERHQFQRDKEATQELIEDLRKQLEHLQLLKLEAEQRRGRSSSMGLQEYHSRARESELEQEVRRLKQDNRNLKEQNEELNGQIITLSIQGAKSLFSTAFSESLAAEISSVSRDELMEAIQKQEEINFRLQDYIDRIIVAIMETNPSILEVK

SEQ ID NO: 60638 - protein, 460 aa, Homo sapiens
MPFLKANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSPTKRLSSKKVARYLHQSGALTMEALEDPSPELMEGPEEDIADKVVFLERRVLELEKDTAATGEQHSRLRQENLQLVHRANALEEQLKEQELRACEMVLEETRRQKELLCKMEREKSIEIENLQTRLQQLDEENSELRSCTPCLKANIERLEEEKQKLLDEIESLTLRLSEEQENKRRMGDRLSHERHQFQRDKEATQELIEDLRKQLEHLQLLKLEAEQRRGRSSSMGLQEYHSRARESELEQEVRRLKQDNRNLKEQNEELNGQIITLSIQGAKSLFSTAFSESLAAEISSVSRDELMEAIQKQEEINFRLQDYIDRIIVAIMETNPSILEVK

SEQ ID NO: 60639 - protein, 182 aa, Homo sapiens
MGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSPTKRLSSKKVARYLHQSGALTMEALEDPSPELMEGPEEDIADKVVFLERRVLELEKDTAATGEQHSRLRQ

SEQ ID NO: 60640 - protein, 801 aa, Homo sapiens
MASAPPASPPGSEPPGPDPEPGGPDGPGAAQLAPGPAELRLGAPVGGPDPQSPGLDEPAPGAAADGGARWSAGPAPGLEGGPRDPGPSAPPPRSGPRGQLASPDAPGPGPRSEAPLPELDPLFSWTEEPEECGPASCPESAPFRLQGSSSSHRARGEVDVFSPFPAPTAGELALEQGPGSPPQPSDLSQTHPLPSEPVGSQEDGPRLRAVFDALDGDGDGFVRIEDFIQFATVYGAEQVKDLTKYLDPSGLGVISFEDFYQGITAIRNGDPDGQCYGGVASAQDEEPLACPDEFDDFVTYEANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSTDPLAAKLHSILTDEAFEFYCSQCHKQINRLEDLSARLSDLEMNSPTKRLSSKKVARYLHQSGALTMEALEDPSPELMEGPEEDIADKVVFLERRVLELEKDTAATGEQHSRLRQENLQLVHRANALEEQLKEQELRACEMVLEETRRQKELLCKMEREKSIEIENLQTRLQQLDEENSELRSCTPCLKANIERLEEEKQKLLDEIESLTLRLSEEQENKRRMGDRLSHERHQFQRDKEATQELIEDLRKQLEHLQLLKLEAEQRRGRSSSMGLQEYHSRARESELEQEVRRLKQDNRNLKEQNEELNGQIITLSIQGAKSLFSTAFSESLAAEISSVSRDELMEAIQKQEEINFRLQDYIDRIIVAIMETNPSILEVK

SEQ ID NO: 60641 - protein, 637 aa, Homo sapiens
MAGGAGWSGAPAALLRSVRRLREVFEVCGRDPDGFLRVERVAALGLRFGQGEEVEKLVKYLDPNDLGRINFKDFCRGVFAMKGCEELLKDVLSVESAGTLPCAPEIPDCVEQGSEVTGPTFADGELIPREPGFFPEDEEEAMTLAPPEGPQELYTDSPMESTQSLEGSVGSPAEKDGGLGGLFLPEDKSLVHTPSMTTSDLSTHSTTSLISNEEQFEDYGEGDDVDCAPSSPCPDDETRTNVYSDLGSSVSSSAGQTPRKMRHVYNSELLDVYCSQCCKKINLLNDLEARLKNLKANSPNRKISSTAFGRQLMHSSNFSSSNGSTEDLFRDSIDSCDNDITEKVSFLEKKVTELENDSLTNGDLKSKLKQENTQLVHRVHELEEMVKDQETTAEQALEEEARRHREAYGKLEREKATEVELLNARVQQLEEENTELRTTVTRLKSQTEKLDEERQRMSDRLEDTSLRLKDEMDLYKRMMDKLRQNRLEFQKEREATQELIEDLRKELEHLQMYKLDCERPGRGRSASSGLGEFNARAREVELEHEVKRLKQENYKLRDQNDDLNGQILSLSLYEAKNLFAAQTKAQSLAAEIDTASRDELMEALKEQEEINFRLRQYMDKIILAILDHNPSILEIKH

SEQ ID NO: 60642 - protein, 637 aa, Homo sapiens; identical to SEQ ID NO: 60641

SEQ ID NO: 60643 - protein, 216 aa, Homo sapiens
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNGLSFIETSALDSTNVEAAFQTILTEIYRIVSQKQMSDRRENDMSPSNNVVPIHVPPTTENKPKVQCCQNI

SEQ ID NO: 60644 - protein, 155 aa, Homo sapiens
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAGYNKANVRQTRK

SEQ ID NO: 60645 - protein, 203 aa, Homo sapiens
MAKAYDHLFKLLLIGDSGVGKTCLIIRFAEDNFNNTYISTIGIDFKIRTVDIEGKKIKLQVWDTAGQERFKTITTAYYRGAMGIILVYDITDEKSFENIQNWMKSIKENASAGVERLLLGNKCDMEAKRKVQKEQADKLAREHGIRFFETSAKSSMNVDEAFSSLARDILLKSGGRRSGNGNKPPSTDLKTCDKKNTNKCSLG

SEQ ID NO: 60646 - protein, 215 aa, Homo sapiens
MATAPYNYSYIFKYIIIGDMGVGKSCLLHQFTEKKFMADCPHTIGVEFGTRIIEVSGQKIKLQIWDTAGQERFRAVTRSYYRGAAGALMVYDITRRSTYNHLSSWLTDARNLTNPNTVIILIGNKADLEAQRDVTYEEAKQFAEENGLLFLEASAKTGENVEDAFLEAAKKIYQNIQDGSLDLNAAESGVQHKPSAPQGGRLTSEPQPQREGCGC

SEQ ID NO: 60647 - protein, 181 aa, Homo sapiens
MATAPYNYSYIFKYIIIGDMGVGKSCLLHQFTEKKFMADCPHTIGVEFGTRIIEVSGQKIKLQIWDTAGQERFRAVTRSYYRGAAGALMVYDITRRSTYNHLSSWLTDARNLTNPNTVIILIGNKADLEAQRDVTYEEAKQFAEENGLLFLEASAKTGENVEDAFLEAAKKIYQNIQDGSL

SEQ ID NO: 60648 - protein, 236 aa, Homo sapiens
MGQKASQQLALKDSKEVPVVCEVVSEAIVHAAQKLKEYLGFEYPPSKLCPAANTLNEIFLIHFITFCQEKGVDEWLTTTKMTKHQAFLFGADWIWTFWGSNKQIKLQLAVQTLQMSSPPPVESKPCDLSNPESRVEESSWKKSRFDKLEEFCNLIGEDCLGLFIIFGMPGKPKDIRGVVLDSVKSQMVRSHLPGGKAVAQFVLETEDCVFIKELLRNCLSKKDGLREVGKVYISIL

SEQ ID NO: 60649 - protein, 212 aa, Homo sapiens
MAQAHRTPQPRAAPSQPRVFKLVLLGSGSVGKSSLALRYVKNDFKSILPTVGCAFFTKVVDVGATSLKLEIWDTAGQEKYHSVCHLYFRGANAALLVYDITRKDSFLKAQQWLKDLEEELHPGEVLVMLVGNKTDLSQEREVTFQEGKEFADSQKLLFMETSAKLNHQVSEVFNTVAQELLQRSDEEGQALRGDAAVALNKGPARQAKCCAH

SEQ ID NO: 60650 - protein, 85 aa, Homo sapiens
MLVGNKTDLSQEREVTFQEGKEFADSQKLLFMETSAKLNHQVSEVFNTVAQELLQRSDEEGQALRGDAAVALNKGPARQAKCCAH

SEQ ID NO: 60651 - protein, 206 aa, Homo sapiens
MDEDVLTTLKILIIGESGVGKSSLLLRFTDDTFDPELAATIGVDFKVKTISVDGNKAKLAIWDTAGQERFRTLTPSYYRGAQGVILVYDVTRRDTFVKLDNWLNELETYCTRNDIVNMLVGNKIDKENREVDRNEGLKFARKHSMLFIEASAKTCDGVQCAFEELVEKIIQTPGLWESENQNKGVKLSHREEGQGGGACGGYCSVL

SEQ ID NO: 60652 - protein, 161 aa, Homo sapiens
MDEDVLTTLKILIIGESGVGKSSLLLRFTDDTFDPELAATIVYDVTRRDTFVKLDNWLNELETYCTRNDIVNMLVGNKIDKENREVDRNEGLKFARKHSMLFIEASAKTCDGVQCAFEELVEKIIQTPGLWESENQNKGVKLSHREEGQGGGACGGYCSVL

SEQ ID NO: 60653 - protein, 291 aa, Homo sapiens
  MOD_RES (1)..(1): Any amino acid
XRLPGSRPLPGPSSLGRSPSCSAEKTPFRGPPLGRQSAVKELDLVTAGKFRFSVRSECFSRGPPLKIKCNCYFSFCHILWRQKISVVLSFFTFSLGKIILTVELSISLLLRFTDDTFDPELAATIGVDFKVKTISVDGNKAKLAIWVTLHQQTANFFLKSQIGNSPILKWAMWQYDTAGQERFRTLTPSYYRGAQGVILVYDVTRRDTFVKLDNWLNELETYCTRNDIVNMLVGNKIDKENREVDRNEGLKFARKHSMLFIEASAKTCDGVQCAFEELVEKIIQTPGLWES

SEQ ID NO: 60654 - protein, 142 aa, Homo sapiens
MDEDVLTTLKILIIGESGVGKSSLLLRFTDDTFDPELAATIGVDFKVKTISVDGNKAKLAIWENREVDRNEGLKFARKHSMLFIEASAKTCDGVQCAFEELVEKIIQTPGLWESENQNKGVKLSHREEGQGGGACGGYCSVL

SEQ ID NO: 60655 - protein, 184 aa, Homo sapiens
MDEDVLTTLKILIIGESGVGKSSLLLRFTDDTFDPELAATDTAGQERFRTLTPSYYRGAQGVILVYDVTRRDTFVKLDNWLNELETYCTRNDIVNMLVGNKIDKENREVDRNEGLKFARKHSMLFIEASAKTCDGVQCAFEELVEKIIQTPGLWESENQNKGVKLSHREEGQGGGACGGYCSVL

SEQ ID NO: 60656 - protein, 129 aa, Homo sapiens
MSSMNPEYDYLFKLLLIGDSGVGKSCLLLRFADDTYTESYISTIGVDFKIRTIELDGKTIKLQIEFADSLGIPFLETSAKNATNVEQSFMTMAAEIKKRMGPGATAGGAEKSNVKIQSTPVKQSGGGCC

SEQ ID NO: 60657 - protein, 129 aa, Homo sapiens
MSCLHPTSDYLFKLLLIGDSGVGKSCLLLRFADDTYTESYISTIGVDFKIRTIELDGKTIKLQIEFADSLGIPFLETSAKNATNVEQSFMTMAAEIKKRMGPGATAGGAEKSNVKIQSTPVKQSGGGCC

SEQ ID NO: 60658 - protein, 173 aa, Homo sapiens
MSSMNPEYDYLFKLLLIGDSGVGKSCLLLRFADDTYTESYISTIGVDFKIRTIELDGKTIKLQIESFNNVKQWLQEIDRYASENVNKLLVGNKCDLTTKKVVDYTTAKEFADSLGIPFLETSAKNATNVEQSFMTMAAEIKKRMGPGATAGGAEKSNVKIQSTPVKQSGGGCC

SEQ ID NO: 60659 - protein, 173 aa, Homo sapiens
MSSMNPEYDYLFKLLLIGDSGVGKSCLLLRFAWDTAGQERFRTITSSYYRGAHGIIVVYDVTDQESFNNVKQWLQEIDRYASENVNKLLVGNKCDLTTKKVVDYTTAKEFADSLGIPFLETSAKNATNVEQSFMTMAAEIKKRMGPGATAGGAEKSNVKIQSTPVKQSGGGCC

SEQ ID NO: 60660 - protein, 205 aa, Homo sapiens
MSSMNPEYDYLFKLLLIGDSGVGKSCLLLRFADDTYTESYISTIGVDFKIRTIELDGKTIKLQIWDTAGQERFRTITSSYYRGAHGIIVVYDVTDQESFNNVKQWLQEIDRYASENVNKLLVGNKCDLTTKKVVDYTTAKEFADSLGIPFLETSAKNATNVEQSFMTMAAEIKKRMGPGATAGGAEKSNVKIQSTPVKQSGGGCC

SEQ ID NO: 60661 - protein, 141 aa, Homo sapiens
MSSMNPEYDYLFKLLLIGDSGVGKSCLLLRFAESFNNVKQWLQEIDRYASENVNKLLVGNKCDLTTKKVVDYTTAKEFADSLGIPFLETSAKNATNVEQSFMTMAAEIKKRMGPGATAGGAEKSNVKIQSTPVKQSGGGCC

SEQ ID NO: 60662 - protein, 201 aa, Homo sapiens
MNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 60663 - protein, 162 aa, Homo sapiens
MNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQGCRRLTAMPARTSISSWWATRATSPPRRWWTTPQPRSLQTLWASPSWRRAPRMPPMSSRRS

SEQ ID NO: 60664 - protein, 119 aa, Homo sapiens
MNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQWLQEIDRYASENVNKLLV

SEQ ID NO: 60665 - protein, 225 aa, Homo sapiens
MAAAGGGGGGAAAAGRAYSFKVVLLGEGCVGKTSLVLRYCENKFNDKHITTLQASFLTKKLNIGGKRVNLAIWDTAGQERFHALGPIYYRDSNGAILVYDITDEDSFQKVKNWVKELRKMLGNEICLCIVGNKIDLEKERHVSIQEAESYAESVGAKHYHTSAKQNKGIEELFLDLCKRMIETAQVDERAKGNGSSQPGTARRGVQIIDDEPQAQTSGGGCCSSG

SEQ ID NO: 60666 - protein, 194 aa, Homo sapiens
MALRELKVCLLGDTGVGKSSIVWRFVEDSFDPNINPTIGASFMTKTVQYQNELHKFLIWDTAGQERFRALAPMYYRGSAAAIIVYDITKEETFSTLKNWVKELRQHGPPNIVVAIAGNKCDLIDVREVMERDAKDYADSIHAIFVETSAKNAININELFIEISRRIPSTDANLPSGGKGFKLRRQPSEPKRSCC

SEQ ID NO: 60667 - protein, 237 aa, Homo sapiens
MLEEDMEVAIKMVVVGNGAVGKSSMIQRYCKGIFTKDYKKTIGVDFLERQIQVNDEDVRLMLWDTAGQEEFDAITKAYYRGAQACVLVFSTTDRESFEAVSSWREKVVAEVGDIPTVLVQNKIDLLDDSCIKNEEAEALAKRLKLRFYRTSVKEDLNVNEVFKYLAEKYLQKLKQQIAEDPELTHSSSNKIGVFNTSGGSHSGQNSGTLNGGDVINLRPNKQRTKKNRNPFSSCSIP

SEQ ID NO: 60668 - protein, 237 aa, Homo sapiens; identical to SEQ ID NO: 60667

SEQ ID NO: 60669 - protein, 203 aa, Homo sapiens
MSGQRVDVKVVMLGKEYVGKTSLVERYVHDRFLVGPYQNTIGAAFVAKVMSVGDRTVTLGIWDTAGSERYEAMSRIYYRGAKAAIVCYDLTDSSSFERAKFWVKELRSLEEGCQIYLCGTKSDLLEEDRRRRRVDFHDVQDYADNIKAQLFETSSKTGQSVDELFQKVAEDYVSVAAFQVMTEDKGVDLGQKPNPYFYSCCHH

SEQ ID NO: 60670 - protein, 203 aa, Homo sapiens; identical to SEQ ID NO: 60669

SEQ ID NO: 60671 - protein, 66 aa, Homo sapiens
MSGQRVDVKVVMLGKEYVGKTSLVERYVHDRFLVGPYQNTIGAAFVAKVMSVGDRTVTLGIWDTAG

SEQ ID NO: 60672 - protein, 213 aa, Homo sapiens
MGNGTEEDYNFVFKVVLIGESGVGKTNLLSRFTRNEFSHDSRTTIGVEFSTRTVMLGTAAVKAQIWDTAGLERYRAITSAYYRGAVGALLVFDLTKHQTYAVVERWLKELYDHAEATIVVMLVGNKSDLSQAREVPTEEARMFAENNGLLFLETSALDSTNVELAFETVLKEIFAKVSKQRQNSIRTNAITLGSAQAGQEPGPGEKRACCISL

SEQ ID NO: 60673 - protein, 256 aa, Homo sapiens
MSRKKTPKSKGASTPAASTLPTANGARPARSGTALSGPDAPPNGPLQPGRPSLGGGVDFYDVAFKVMLVGDSGVGKTCLLVRFKDGAFLAGTFISTVGIDFRNKVLDVDGVKVKLQMWDTAGQERFRSVTHAYYRDAHALLLLYDVTNKASFDNIQAWLTEIHEYAQHDVALMLLGNKVDSAHERVVKREDGEKLAKEYGLPFMETSAKTGLNVDLAFTAIAKELKQRSMKAPSEPRFRLHDYVKREGRGASCCRP

SEQ ID NO: 60674 - protein, 190 aa, Homo sapiens
MLVGDSGVGKTCLLVRFKDGAFLAGTFISTVGIDFRNKVLDVDGVKVKLQMWDTAGQERFRSVTHAYYRDAHALLLLYDVTNKASFDNIQAWLTEIHEYAQHDVALMLLGNKVDSAHERVVKREDGEKLAKEYGLPFMETSAKTGLNVDLAFTAIAKELKQRSMKAPSEPRFRLHDYVKREGRGASCCRP

SEQ ID NO: 60675 - protein, 221 aa, Homo sapiens
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEEEAIALAEKYGIPYFETSAANGTNISQAIEMLLDLIMKRMERCVDKSWIPEGVVRSNGHASTDQLSEEKEKGACGC

SEQ ID NO: 60676 - protein, 213 aa, Homo sapiens
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEKYGIPYFETSAANGTNISQAIEMLLDLIMKRMERCVDKSWIPEGVVRSNGHASTDQLSEEKEKGACGC

SEQ ID NO: 60677 - protein, 221 aa, Homo sapiens; identical to SEQ ID NO: 60675

SEQ ID NO: 60678 - protein, 220 aa, Homo sapiens
MSDSEEESQDRQLKIVVLGDGASGKTSLTTCFAQETFGKQYKQTIGLDFFLRRITLPGNLNVTLQIWDIGGQTIGGKMLDKYIYGAQGVLLVYDITNYQSFENLEDWYTVVKKVSEESETQPLVALVGNKIDLEHMRTIKPEKHLRFCQENGFSSHFVSAKTGDSVFLCFQKVAAEILGIKLNKAEIEQSQRIVRAEIVKYPEEENQHTTSTQSRICSVQ

SEQ ID NO: 60679 - protein, 221 aa, Homo sapiens
MSDSEEESQDRQLKIVVLGDGASGKTSLTTCFAQETFGKQYKQTIGLDFFLRRITLPGNLNVTLQIWDIGGQTIGGKMLDKYIYGAQGVLLVYDITNYQSFENLEDWYTVVKKVSEESETQPLVALVGNKIDLEHMRTIKPEKHLRFCQENGFSSHFVSAKTGDSVFLCFQKVAAEILGIKLNKAEIEQSQRVVKADIVNYNQEPMSRTVNPPRSSMCAVQ

SEQ ID NO: 60680 - protein, 204 aa, Homo sapiens
MSDSEEESQDRQLKIVVLGDGASGKTSLTTCFAQETFGKQYKQTIGLDFFLRRITLPGNLNVTLQIWDIGGQTIGGKMLDKYIYGAQGVLLVYDITNYQSFENLEDWYTVVKKVSEESETQPLVALVGNKIDLEHMRTIKPEKHLRFCQENGFSSHFVSAKTGDSVFLCFQKVAAEILGIKLNKAEIEQSQGHFIIFISSTNRE

SEQ ID NO: 60681 - protein, 95 aa, Homo sapiens
MSDSEEESQDRQLKIVVLGDGASGKTSLTTCFAQETFGKQYKQTIGLDFFLRRITLPGNLNVTLQIWDIGGQTIGGKMLDKYIYGAQLIWSICEQ

SEQ ID NO: 60682 - protein, 212 aa, Homo sapiens
MAYAYLFKYIIIGDTGVGKSCLLLQFTDKRFQPVHDLTIGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 60683 - protein, 188 aa, Homo sapiens
MAYAYLFKYIIIGDTGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 60684 - protein, 166 aa, Homo sapiens
MITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 60685 - protein, 209 aa, Homo sapiens [sequence omitted]

SEQ ID NO: 60686 - protein, 216 aa, Homo sapiens
MTYAYLFKYIIIGDTGVGKSCLLLQFTDKRFQPVHDLTIGVEFGARMVNIDGKQIKLQIWDTAGQESFRSITRSYYRGAAGALLVYDITRRETFNHLTSWLEDARQHSSSNMVIMLIGNKSDLESRRDVKREEGEAFAREHGLIFMETSAKTACNVEEAFINTAKEIYRKIQQGLFDVHNEANGIKIGPQQSISTSVGPSASQRNSRDIGSNSGCC

SEQ ID NO: 60687 - protein, 62 aa, Homo sapiens
MTYAYLFKYIIIGDTGVGKSCLLLQFTDKRFQPVHDLTIGVEFGARMVNIDGKQIKLQIWDT

SEQ ID NO: 60688 - protein, 981 aa, Homo sapiens
MAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEEIIHQITNVEALIARARSLKAKFGTEKCEQEEEKEDLERFVSCLLEQPEVLVTGAGRGHAGRIIHKLFVNAQRAAAMTPPEEELKRMGSPEERRQNSVSDFPPPAGREFILRTTVPRPAPYSKALPQRMYSVLTKEDFRLAGAFSSDTSFF

SEQ ID NO: 60689 - protein, 935 aa, Homo sapiens
MFSLISGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEEIIHQITNVEALIARARSLKAKFGTEKCEQEEEKEDLERFVSCLLEQPEVLVTGAGRGHAGRIIHKLFVNAQRAAAMTPPEEELKRMGSPEERRQNSVSDFPPPAGREFILRTTVPRPAPYSKALPQRMYSVLTKEDFRLAVKIIDGDV

SEQ ID NO: 60690 - protein, 988 aa, Homo sapiens
MAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEEIIHQITNVEALIARARSLKAKFGTEKCEQEEEKEDLERFVSCLLEQPEVLVTGAGRGHAGRIIHKLFVNAQRLTESSDEAAAMTPPEEELKRMGSPEERRQNSVSDFPPPAGREFILRTTVPRPAPYSKALPQRMYSVLTKEDFRLAGAFSSDTSFF

SEQ ID NO: 60691 - protein, 1393 aa, Homo sapiens
MACSIVQFCYFQDLQAARDFLFPHLREEILSGALRRDPSKSTDWEDDGWGAWEENEPQEPEEEGNTCKTQKTSWLQDCVLSLSPTNDLMVIAREQKAVFLVPKWKYSDKGKEEMQFAVGWSGSLNVEEGECVTSALCIPLASQKRSSTGRPDWTCIVVGFTSGYVRFYTENGVLLLAQLLNEDPVLQLKCRTYEIPRHPGVTEQNEELSILYPAAIVTIDGFSLFQSLRACRNQVAKAAASGNENIQPPPLAYKKWGLQDIDTIIDHASVGIMTLSPFDQMKTASNIGGFNAAIKNSPPAMSQYITVGSNPFTGFFYALEGSTQPLLSHVALAVASKLTSALFNAASGWLGWKSKHEEEAVQKQKPKVEPATPLAVRFGLPDSRRHGESICLSPCNTLAAVTDDFGRVILLDVARGIAIRMWKGYRDAQIGWIQTVEDLHERVPEKADFSPFGNSQGPSRVAQFLVIYAPRRGILEVWSTQQGPRVGAFNVGKHCRLLYPGYKIMGLNNVTSQSWQPQTYQICLVDPVSGSVKTVNVPFHLALSDKKSERAKDMHLVKKLAALLKTKSPNLDLVETEIKELILDIKYPATKKQALESILASERLPFSCLRNITQTLMDTLKSQELESVDEGLLQFCANKLKLLQLYESVSQLNSLDFHLDTPFSDNDLALLLRLDEKELLKLQALLEKYKQENTRTNVRFSDDKDGVLPVKTFLEYLEYEKDVLNIKKISEEEYVALGSFFFWKCLHGESSTEDMCHTLESAGLSPQLLLSLLLSVWLSKEKDILDKPQSICCLHTMLSLLSKMKVAIDETWDSQSVSPWWQQMRTACIQSENNGAALLSAHVGHSVAAQISNNMTEKKFSQTVLGADSEALTDSWEALSLDTEYWKLLLKQLEDCLILQTLLHSKGNTQTSKVSSLQAEPLPRLSVKKLLEGGKGGIADSVAKWIFKQDFSPEVLKLANEERDAENPDEPKEGVNRSFLEVSEMEMDLGAIPDLLHLAYEQFPCSLELDVLHAHCCWEYVVQWNKDPEEARFFVRSIEHLKQIFNAHVQNGIALMMWNTFLVKRFSAATYLMDKVGKSPKDRLCRRDVGMSDTAMTSFLGSCLDLLQILMEADVSRDEIQVPVLDTEDAWLSVEGPISIVELALEQKHIHYPLVEHHSILCSILYAVMRFSLKTVKPLSLFDSKGKNAFFKDLTSIQLLPSGEMDPNFISVRQQFLLKVVSAAVQAQHSATKVKDPTEEATPTPFGKDQDWPALAVDLAHHLQVSEDVVRRHYVGELYNYGVDHLGEEAILQVHDKEVLASQLLVLTGQRLAHALLHTQTKEGMELLARLPPTLCTWLKAMDPQDLQNTEVPIATTAKLVNKVIELLPEKHGQYGLALHLIEAVEAISLPSL

SEQ ID NO: 60692 - protein, 203 aa, Homo sapiens
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNKVITVLVGNKIDLAERREVSQQRAEEFSEAQDMYYLETSAKESDNVEKLFLDLACRLISEARQNTLVNNVSSPLPGEGKSISYLTCCNFN

SEQ ID NO: 60693 - protein, 114 aa, Homo sapiens
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNK

SEQ ID NO: 60694 - protein, 203 aa, Homo sapiens; identical to SEQ ID NO: 60692

SEQ ID NO: 60695 - protein, 55 aa, Homo sapiens
MSMEDYDFLFKIVLIGNAGVGKTCLVRRFTQGLFPPGQGATIGVDFMIKTVEING

SEQ ID NO: 60696 - protein, 168 aa, Homo sapiens
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNKVITVLVGNKIDLAERREVSQQRAEEFSEAQDMYYLETSAKESDNVEKLFLDLAC

SEQ ID NO: 60697 - protein, 60 aa, Homo sapiens
MSMEDYDFLFKIVLIGNAGVGKTCLVRRFTQGLFPPGQGATIGVDFMIKTVEINGEKVKL

SEQ ID NO: 60698 - protein, 203 aa, Homo sapiens; identical to SEQ ID NO: 60692

SEQ ID NO: 60699 - protein, 100 aa, Homo sapiens
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCL

SEQ ID NO: 60700 - protein, 164 aa, Homo sapiens
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNKVITVLATRLTWLKGERFPSSELKNSQKLRTCIIWRPQPRNLIMWRNSSLT

SEQ ID NO: 60701 - protein, 139 aa, Homo sapiens
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNKVITVLVGNKIDLAERREVSQQRAEE

SEQ ID NO: 60702 - protein, 195 aa, Homo sapiens
MMAIRELKVCLLGDTGVGKSSIVCRFVQDHFDHNISPTIGASFMTKTVPCGNELHKFLIWDTAGQERFHSLAPMYYRGSAAAVIVYDITKQDSFYTLKKWVKELKEHGPENIVMAIAGNKCDLSDIREVPLKDAKEYAESIGAIVVETSAKNAINIEELFQGISRQIPPLDPHENGNNGTIKVEKPTMQASRRCC

SEQ ID NO: 60703 - protein, 186 aa, Homo sapiens
CLLNDTGVGKSSIVCRFVQDHFDHNISPTIGASFMTKTVPCGNELHKFLIWDTAGQERFHSLAPMYYRGSAAAVIVYDITKQDSFYTLKKWVKELKEHGPENIVMAIAGNKCDLSDIREVPLKDAKEYAESIGAIVVETSAKNAINIEELFQGISRQIPPLDPHENGNNGTIKVEKPTMQASRRCC

SEQ ID NO: 60704 - protein, 225 aa, Homo sapiens
MAGGGAGDPGLGAAAAPAPETREHLFKVLVIGELGVGKTSIIKRYVHQLFSQHYRATIGVDFALKVLNWDSRTLVRLQLWDIAGQERFGNMTRVYYKEAVGAFVVFDISRSSTFEAVLKWKSDLDSKVHLPNGSPIPAVLLANKCDQNKDSSQSPSQVDQFCKEHGFAGWFETSAKDNINIEEAARFLVEKILVNHQSFPNEENDVDKIKLDQETLRAENKSQCC

SEQ ID NO: 60705 - protein, 237 aa, Homo sapiens
MAQPILGHGSLQPASAAGLASLELDSSLDQYVQIRIFKIIVIGDSNVGKTCLTFRFCGGTFPDKTEATIGVDFREKTVEIEGEKIKVQVWDTAGQERFRKSMVEHYYRNVHAVVFVYDVTKMTSFTNLKMWIQECNGHAVPPLVPKVLVGNKCDLREQIQVPSNLALKFADAHNMLLFETSAKDPKESQNVESIFMCLACRLKAQKSLLYRDAERQQGKVQKLEFPQEANSKTSCPC

SEQ ID NO: 60706 - protein, 237 aa, Homo sapiens
MNILAPVRRDRVLAELPQCLRKEAALHGHKDFHPRVTCACQEHRTGTVGFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCCP

SEQ ID NO: 60707 - protein, 259 aa, Homo sapiens
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCCP

SEQ ID NO: 60708 - protein, 211 aa, Homo sapiens
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFR

SEQ ID NO: 60709 - protein, 251 aa, Homo sapiens
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLTPAQYALMEKDALQVAQEMKAEYWAVSSLTGENVREFFFRVAALTFEANVLAELEKSGARRIGDVVRINSDDSNLYLTASKKKPTCCP

SEQ ID NO: 60710 - protein, 259 aa, Homo sapiens; identical to SEQ ID NO: 60707

SEQ ID NO: 60711 - protein, 211 aa, Homo sapiens; identical to SEQ ID NO: 60708

SEQ ID NO: 60712 - protein, 231 aa, Homo sapiens
  MOD_RES (1)..(1): Any amino acid
XSLRFPITNSAGAPCKAAGRMNILAPVRRDRVLAELPQCLRKEAALHGHKDFHPRVTCACQEHRTGTVGRFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKTVQRLPSPRALCHPHSSRA

SEQ ID NO: 60713 - protein, 316 aa, Homo sapiens
MSHLPGLELRREAPPLLGPLLSPFPLPAGSWHRQMLRSSLRFPITNSAGAPCKAAGRMNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCCP

SEQ ID NO: 60714 - protein, 274 aa, Homo sapiens
MLRSSLRFPITNSAGAPCKAAGRMNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLTPAQYALMEKDALQVAQEMKAEYWAVSSLTGENVREFFFRVAALTFEANVLAELEKSGARRIGDVVRINSDDSNLYLTASKKKPTCCP

SEQ ID NO: 60715 - protein, 268 aa, Homo sapiens
MSHLPGLELRREAPPLLGPLLSPFPLPAGSWHRQMLRSSLRFPITNSAGAPCKAAGRMNILAPVRRDRVLAELPQCLRKEAALHGHKDFHPRVTCACQEHRTGTVGRFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKTVQRLPSPRALCHPHSSRA

SEQ ID NO: 60716 - protein, 333 aa, Homo sapiens
MVIAGASWMLGRAAASPTQTPPTTSTIRVARRSRVALVAMVIAAAGSGGPGRAEPQLSQPSLDCGRMRSSLTPLGPPVSRDRVIASFPKWYTPEACLQLREHFHGQVSAACQRRNTGTVGLKLSKVVVVGDLYVGKTSLIHRFCKNVFDRDYKATIGVDFEIERFEIAGIPYSLQIWDTAGQEKFKCIASAYYRGAQVIITAFDLTDVQTLEHTRQWLEDALRENEAGSCFIFLVGTKKDLLSGAACEQAEADAVHLAREMQAEYWSVSAKTGENVKAFFSRVAALAFEQSVLQDLERQSSARLQVGNGDLIQMEGSPPETQESKRPSSLGCC

SEQ ID NO: 60717 - protein, 311 aa, Homo sapiens
MVIAGASWMLGRAAASPTQTPPTTSTIRVARRSRVALVAMVIAAAGSGGPGRAEPQLSQPSLDCGRMRSSLTPLGPPVSRDRVIASFPKWYTPEACLQLREHFHGQVSAACQRRNTGTVGFCKNVFDRDYKATIGVDFEIERFEIAGIPYSLQIWDTAGQEKFKCIASAYYRGAQVIITAFDLTDVQTLEHTRQWLEDALRENEAGSCFIFLVGTKKDLLSGAACEQAEADAVHLAREMQAEYWSVSAKTGENVKAFFSRVAALAFEQSVLQDLERQSSARLQVGNGDLIQMEGSPPETQESKRPSSLGCC

SEQ ID NO: 60718 - protein, 165 aa, Homo sapiens
MVIAAAGSGGPGRAEPQLSQPSLDCGRMRSSLTPLGPPVSRDRVIASFPKWYTPEACLQLREHFHGQVSAACQRRNTGTVGLKLSKVVVVGDLYVGKTSLSAQYAHPQGFLTAMNQPHSPRPLSPGYAHSSHPSRAVASRRWRAPCRQPSDQYCSPRAWHTAAAL

SEQ ID NO: 60719 - protein, 182 aa, Homo sapiens
MDLQRPDSYQGGAGPDFNDHVLHKTILVGDSGVGKTSLLVQFDQGKFIPGSFSATVGIGFTNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAK

SEQ ID NO: 60720 - protein, 189 aa, Homo sapiens
MTGTPGAVATRDGEAPERSPPCSPSYDLTGKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAK

SEQ ID NO: 60721 - protein, 186 aa, Homo sapiens
MTGTPGAVATRDGEAPERSPPCSPSYDLTGKNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 60722 - protein, 223 aa, Homo sapiens
MTGTPGAVATRDGEAPERSPPCSPSYDLTGKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 60723 - protein, 228 aa, Homo sapiens
MWLMSEAHGAEPVLLREAARPFTQTLRLCVPSGNSKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 60724 - protein, 191 aa, Homo sapiens
MWLMSEAHGAEPVLLREAARPFTQTLRLCVPSGNSKNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 60725 - protein, 169 aa, Homo sapiens
MDLQRPDSYQGGAGPDFNDHVLHKTILVGDSGVGKTSLLVQFDQGKFIPGSFSATVGIGFTNKVVTVDGVRVKLQIWDTAGQERFRSVTHAYYRDAQALLLLYDITNKSSFDNIRAWLTEIHEYAQRDVVIMLLGNKVSGSGAGSAQPCTSSALAGPITTQEQLSRHPS

SEQ ID NO: 60726 - protein, 216 aa, Homo sapiens
MDLQRPDSYQGGAGPDFNDHVLHKTILVGDSGVGKTSLLVQFDQGKFIPGSFSATVGIGFTNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 60727 - protein, 216 aa, Homo sapiens; identical to SEQ ID NO: 60726

SEQ ID NO: 60728 - protein, 223 aa, Homo sapiens; identical to SEQ ID NO: 60722

SEQ ID NO: 60729 - protein, 196 aa, Homo sapiens
MCCKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 60730 - protein, 211 aa, Homo sapiens
MQAPHKEHLYKLLVIGDLGVGKTSIIKRYVHQNFSSHYRATIGVDFALKVLHWDPETVVRLQLWDIAGQERFGNMTRVYYREAMGAFIVFDVTRPATFEAVAKWKNDLDSKLSLPNGKPVSVVLLANKCDQGKDVLMNNGLKMDQFCKEHGFVGWFETSAKENINIDEASRCLVKHILANECDLMESIEPDVVKPHLTSTKVASCSGCAKS

SEQ ID NO: 60731 - protein, 213 aa, Homo sapiens
MEAIWLYQFRLIVIGDSTVGKSCLIRRFTEGRFAQVSDPTVGVDFFSRLVEIEPGKRIKLQIWDTAGQERFRSITRAYYRNSVGGLLLFDITNRRSFQNVHEWLEETKVHVQPYQIVFVLVGHKCDLDTQRQVTRHEAEKLAAAYGMKYIETSARDAINVEKAFTDLTRDIYELVKRGEITIQEGWEGVKSGFVPNVVHSSEEVVKSERRCLC

SEQ ID NO: 60732 - protein, 220 aa, Homo sapiens
MASATDSRYGQKESSDQNFDYMFKILIIGNSSVGKTSFLFRYADDSFTPAFVSTVGIDFKVKTIYRNDKRIKLQIWDTAGQERYRTITTAYYRGAMGFILMYDITNEESFNAVQDWSTQIKTYSWDNAQVLLVGNKCDMEDERVVSSERGRQLADHLGFEFFEASAKDNINVKQTFERLVDVICEKMSESLDTADPAVTGAKQGPQLSDQQVPPHQDCAC

SEQ ID NO: 60733 - protein, 219 aa, Homo sapiens
MASVTDGKTGVKDASDQNFDYMFKLLIIGNSSVGKTSFLFRYADDTFTPAFVSTVGIDFKVKTVYRHEKRVKLQIWDTAGQERYRTITTAYYRGAMGFILMYDITNEESFNAVQDWATQIKTYSWDNAQVILVGNKCDMEEERVVPTEKGQLLAEQLGFDFFEASAKENISVRQAFERLVDAICDKMSDSLDTDPSMLGSSKNTRLSDTPPLLQQNCSC

SEQ ID NO: 60734 - protein, 219 aa, Homo sapiens; identical to SEQ ID NO: 60733

SEQ ID NO: 60735 - protein, 227 aa, Homo sapiens
MRHEAPMQMASAQDARYGQKDSSDQNFDYMFKLLIIGNSSVGKTSFLFRYADDSFTSAFVSTVGIDFKVKTVFKNEKRIKLQIWDTAGQERYRTITTAYYRGAMGFILMYDITNEESFNAVQDWSTQIKTYSWDNAQVILVGNKCDMEDERVISTERGQHLGEQLGFEFFETSAKDNINVKQTFERLVDIICDKMSESLETDPAITAAKQNTRLKETPPPPQPNCAC

SEQ ID NO: 60736 - protein, 278 aa, Homo sapiens
MSAPGSPDQAYDFLLKFLLVGDRDVGKSEILESLQDGTAESPYSHLGGIDYKTTTILLDGQRVKLKLWDTSGQGRFCTIFRSYSRGAQGVILVYDIANRWSFEGMDRWIKKIEEHAPGVPKILVGNRLHLAFKRQVPREQAQAYAERLGVTFFEVSPLCNFNIIESFTELARIVLLRHRLNWLGRPSKVLSLQDLCCRTIVSCTPVHLVDKLPLPIALRSHLKSFSMAKGLNARMMRGLSYSLTTSSTHKRSSLCKVKIVCPPQSPPKNCTRNSCKIS

SEQ ID NO: 60737 - protein, 218 aa, Homo sapiens
MSQTAMSETYDFLFKFLVIGNAGTGKSCLLHQFIEKKFKDDSNHTIGVEFGSKIINVGGKYVKLQIWDTAGQERFRSVTRSYYRGAAGALLVYDITSRETYNALTNWLTDARMLASQNIVIILCGNKKDLDADREVTFLEASRFAQENELMFLETSALTGENVEEAFVQCARKILNKIESGELDPERMGSGIQYGDAALRQLRSPRRAQAPNAQECGC

SEQ ID NO: 60738 - protein, 215 aa, Homo sapiens
MASRGATRPNGPNTGNKICQFKLVLLGESAVGKSSLVLRFVKGQFHEFQESTIGAAFLTQTVCLDDTTVKFEIWDTAGQERYHSLAPMYYRGAQAAIVVYDITNEESFARAKNWVKELQRQASPNIVIALSGNKADLANKRAVDFQEAQSYADDNSLLFMETSAKTSMNVNEIFMAIAKKLPKNEPQNPGANSARGRGVDLTEPTQPTRNQCCSN

SEQ ID NO: 60739 - protein, 201 aa, Homo sapiens
MASRGATRPNGPNTGNKICQFKLVLLGESAVGKSSLVLRFVKGQFHEFQESTIGVKFEIWDTAGQERYHSLAPMYYRGAQAAIVVYDITNEESFARAKNWVKELQRQASPNIVIALSGNKADLANKRAVDFQEAQSYADDNSLLFMETSAKTSMNVNEIFMAIAKKLPKNEPQNPGANSARGRGVDLTEPTQPTRNQCCSN

SEQ ID NO: 60740 - protein, 15 aa, Homo sapiens
MASRGATRPNGPNTG

SEQ ID NO: 60741 - protein, 215 aa, Homo sapiens
MTSRSTARPNGQPQASKICQFKLVLLGESAVGKSSLVLRFVKGQFHEYQESTIGAAFLTQSVCLDDTTVKFEIWDTAGQERYHSLAPMYYRGAQAAIVVYDITNQETFARAKTWVKELQRQASPSIVIALAGNKADLANKRMVEYEEAQAYADDNSLLFMETSAKTAMNVNDLFLAIAKKLPKSEPQNLGGAAGRSRGVDLHEQSQQNKSQCCSN

SEQ ID NO: 60742 - protein, 174 aa, Homo sapiens
MTSRSTARPNGQPQASKICQFKLVLLGESAVGKSSLVLRFVKGQFHEYQESTIGAAFLTQSVCLDDTTVKFEIWDTAGQERYHSLAPMYYRGAQAAIVVYDITNQEAQAYADDNSLLFMETSAKTAMNVNDLFLAIAKKLPKSEPQNLGGAAGRSRGVDLHEQSQQNKSQCCSN

SEQ ID NO: 60743 - protein, 115 aa, Homo sapiens
MTSRSTARPNGQPQASKICQFKLVLLGESAVGKSSLVLRFVKGQFHEYQESTIGAAFLTQSVCLDDTTVKFEIWDTAGQERYHSLAPMYYRGAQAAIVVYDITNQETFARAKTWV

SEQ ID NO: 60744 - protein, 100 aa, Homo sapiens
MTSRSTARPNGQPQASKICQFKLVLLGESAVGKSSLVLRFVKGQFHEYQESTIGAAFLTQSVCLDDTTVKFEIWDTAGQERYHSLAPMYYRGAQAAIVVY

SEQ ID NO: 60745 - protein, 215 aa, Homo sapiens; identical to SEQ ID NO: 60741

SEQ ID NO: 60746 - protein, 216 aa, Homo sapiens
MAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 60747 - protein, 216 aa, Homo sapiens; identical to SEQ ID NO: 60746

SEQ ID NO: 60748 - protein, 249 aa, Homo sapiens
MELSWRSPSPLSASLHSTSPHPHALWTTTAGRAMAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 60749 - protein, 74 aa, Homo sapiens
MAGRGGAARPNGPAAGNKICQFKLVLLGESAVGKSSLVLRFVKGQFHEYQESTIGAAFLTQTVCLDDTTVKFEI

SEQ ID NO: 60750 - protein, 92 aa, Homo sapiens
MAGRGGAARPNGPAAGNKICQFKLVLLGESAVGKSSLVLRFVKGQFHEYQESTIGAAFLTQTVCLDDTTVKFEIWDTAGQERYHSLAPMYYR

SEQ ID NO: 60751 - protein, 124 aa, Homo sapiens
MAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQAS

SEQ ID NO: 60752 - protein, 208 aa, Homo sapiens
MSTGGDFGNPLRKFKLVFLGEQSVGKTSLITRFMYDSFDNTYQATIGIDFLSKTMYLEDRTIRLQLWDTAGQERFRSLIPSYIRDSAAAVVVYDITNVNSFQQTTKWIDDVRTERGSDVIIMLVGNKTDLADKRQVSIEEGERKAKELNVMFIETSAKAGYNVKQLFRRVAAALPGMESTQDRSREDMIDIKLEKPQEQPVSEGGCSC

SEQ ID NO: 60753 - protein, 208 aa, Homo sapiens
MSTGGDFGNPLRKFKLVFLGEQSVGKTSLITRFMYDSFDNTYQATIGIDFLSKTMYLEDRTVRLQLWDTAGQERFRSLIPSYIRDSTVAVVVYDITNVNSFQQTTKWIDDVRTERGSDVIIMLVGNKTDLADKRQVSIEEGERKAKELNVMFIETSAKAGYNVKQLFRRVAAALPGMESTQDRSREDMIDIKLEKPQEQPVSEGGCSC

SEQ ID NO: 60754 - protein, 208 aa, Homo sapiens; identical to SEQ ID NO: 60752

SEQ ID NO: 60755 - protein, 174 aa, Homo sapiens
  MOD_RES (1)..(1): Any amino acid
XPLRKFKLVFLGEQSVGKTSLITRFMYDSFDNTYQATIGIDFLSKTMYLEDRTVRLQLWDTAGQERFRSLIPSYIRDSTVAVVVYDITNVNSFQQTTKWIDDVRTERGSDVIIMLVGNKTDLADKRQVSIEEGERKAKELNVMFIETSAKAGYNVKQRIGSCHVAQASLELLDS

SEQ ID NO: 60756 - protein, 74 aa, Homo sapiens
MSTGGDFGNPLRKFKLVFLGEQSVGKTSLITRFMYDSFDNTYQATIGIDFLSKTMYLEDRTVRLQLWDTAGQER

SEQ ID NO: 60757 - protein, 175 aa, Homo sapiens
MYDSFDNTYQATIGIDFLSKTMYLEDRTIRLQLWDTAGQERFRSLIPSYIRDSAAAVVVYDITNVNSFQQTTKWIDDVRTERGSDVIIMLVGNKTDLADKRQVSIEEGERKAKELNVMFIETSAKAGYNVKQLFRRVAAALPGMESTQDRSREDMIDIKLEKPQEQPVSEGGCSC

SEQ ID NO: 60758 - protein, 142 aa, Homo sapiens
MSTGGDFGNPLRKFKLVFLGEQSVGKTSLITRFMYDSFDNTYQATIGIDFLSKTMYLEDRTIRLQLWDTAGQERFRSLIPSYIRDSAAAVVVYDITNVNSFQQTTKWIDDVRTERGSDVIIMLVGNKTDLADKRQVSIEEGE

SEQ ID NO: 60759 - protein, 104 aa, Homo sapiens
MSTGGDFGNPLRKFKLVFLGEQSVGKTSLITRFMYDSFDNTYQATIGIDFLSKTMYLEDRTLFRRVAAALPGMESTQDRSREDMIDIKLEKPQEQPVSEGGCSC

SEQ ID NO: 60760 - protein, 201 aa, Homo sapiens
  MOD_RES (1)..(1): Any amino acid
XVFPRGLALRSADVVEVGKTSLITRFMYDSFDNTYQATIGIDFLSKTMYLEDRTIRLQLWDTAGQERFRSLIPSYIRDSAAAVVVYDITNVNSFQQTTKWIDDVRTERGSDVIIMLVGNKTDLADKRQVSIEEGERKAKELNVMFIETSAKAGYNVKQLFRRVAAALPGMESTQDRSREDMIDIKLEKPQEQPVSEGGCSC

SEQ ID NO: 60761 - protein, 47 aa, Homo sapiens
MSTGGDFGNPLRKFKLVFLGEQSVGKTSLITRFMYDSFDNTYQATIG

SEQ ID NO: 60762 - protein, 254 aa, Homo sapiens
MSAGGDFGNPLRKFKLVFLGEQSVAKTSLITRFRYDSFDNTYQAIIGIDFLSKTMYLEDGTIGLRLWDTAGQERLRSLIPRYIRDSAAAVVVYDITNVNSFQQTTKWIDDVRTERGSDVIITLVGNRTDLADKRQVSVEEGERKAKGLNVTFIETRAKAGYNVKQLFRRVAAALPGMESTQDGSREDMSDIKLEKPQEQTVSEGGCSCYSPMSSSTLPQKPPYSFIDCSVNIGLNLFPSLITFCNSSLLPVSWR

SEQ ID NO: 60763 - protein, 203 aa, Homo sapiens
MGSRDHLFKVLVVGDAAVGKTSLVQRYSQDSFSKHYKSTVGVDFALKVLQWSDYEIVRLQLWDIAGQERFTSMTRLYYRDASACVIMFDVTNATTFSNSQRWKQDLDSKLTLPNGEPVPCLLLANKCDLSPWAVSRDQIDRFSKENGFTGWTETSVKENKNINEAMRVLIEKMMRNSTEDIMSLSTQGDYINLQTKSSSWSCC

SEQ ID NO: 60764 - protein, 203 aa, Homo sapiens; identical to SEQ ID NO: 60763

SEQ ID NO: 60765 - protein, 203 aa, Homo sapiens; identical to SEQ ID NO: 60763

SEQ ID NO: 60766 - protein, 131 aa, Homo sapiens
MTRLYYRDASACVIMFDVTNATTFSNSQRWKQDLDSKLTLPNGEPVPCLLLANKCDLSPWAVSRDQIDRFSKENGFTGWTETSVKENKNINEAMRVLIEKMMRNSTEDIMSLSTQGDYINLQTKSSSWSCC

SEQ ID NO: 60767 - protein, 179 aa, Homo sapiens
MGSRDHLFKVLVVGDAAVGKTSLVQRYSQDSFSKHYKSTVGGQERFTSMTRLYYRDASACVIMFDVTNATTFSNSQRWKQDLDSKLTLPNGEPVPCLLLANKCDLSPWAVSRDQIDRFSKENGFTGWTETSVKENKNINEAMRVLIEKMMRNSTEDIMSLSTQGDYINLQTKSSSWSCC

SEQ ID NO: 60768 - protein, 207 aa, Homo sapiens
MAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGIKFMETSAKANINVENAFFTLARDIKAKMDKKLEGNSPQGSNQGVKITPDQQKRSSFFRCVLL

SEQ ID NO: 60769 - protein, 201 aa, Homo sapiens
MSGKSLLLKVILLGDGGVGKSSLMNRYVTNKFDSQAFHTIGVEFLNRDLEVDGRFVTLQIWDTAGQERFKSLRTPFYRGADCCLLTFSVDDRQSFENLGNWQKEFIYYADVKDPEHFPFVVLGNKVDKEDRQVTTEEAQTWCMENGDYPYLETSAKDDTNVTVAFEEAVRQVLAVEEQLEHCMLGHTIDLNSGSKAGSSCC

SEQ ID NO: 60770 - protein, 862 aa, Homo sapiens
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVKELNHYLEAEKSCRTDLEMYVAVLNTQKSVLQEDAEKLRKELHEVCHLLEQERQQHNQLKHTWQKANDQFLESQRLLMRDMQRMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVQLERIRQADSLERIRAILNDTKLTDINQLPET

SEQ ID NO: 60771 - protein, 829 aa, Homo sapiens
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVKELNHYLEAEKSCRTDLEMYVAVLNTQKSVLQEDAEKLRKELHEVCHLLEQERQQHNQLKHTWQKANDQFLESQRLLMRDMQRMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQATVEQLMFEEKNKAQRLQTELDVSEQVQRDFVKLSQTLQVQLERIRQADSLERIRAILNDTKLTDINQLPET

SEQ ID NO: 60772 - protein, 829 aa, Homo sapiens; identical to SEQ ID NO: 60771

SEQ ID NO: 60773 - protein, 819 aa, Homo sapiens
MAQPGPASQPDEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVKELNHYLEAEKSCRTDLEMYVAVLNTQKSVLQEDAEKLRKELHEVCHLLEQERQQHNQLKHTWQKANDQFLESQRLLMRDMQRMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVQLERIRQADSLERIRAILNDTKLTDINQLPET

SEQ ID NO: 60774 - protein, 716 aa, Homo sapiens
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVKELNHYLEAEKSCRTDLEMYVAVLNTQKSVLQEDAEKLRKELHQERQQHNQLKHTWQKANDQFLESQRLLMRDMQRMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKKKK

SEQ ID NO: 60775 - protein, 862 aa, Homo sapiens; identical to SEQ ID NO: 60770

SEQ ID NO: 60776 - protein, 533 aa, Homo sapiens
MAAAAPVAADDDERRRRPGAALEDSRSQEGANGEAESGELSRLRAELAGALAEMETMKAVAEVSESTKAEAVAAVQRQCQEEVASLQAILKDSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDTQWEQLQTEMQVLLAQVQNSEQLLRTLQGTVSQAQERVQLQMAELVTTHKCLHHEVKRLNEENQGLRAEQLPSSAPQGSQQEQGEEESLPSSVPELQQLLCCTRQEARARLQAQEHGAERLRIEIVTLREALEEETVARASLEGQLRVQREETASLCSLRTEMERVQQEQSKAQLPDLLSEQRAKVLRLQAELETSEQVQRDFVRLSQALQVRLERIRQAETLEQVRSIMDEAPLTDVRDIKDT

SEQ ID NO: 60777 - protein, 569 aa, Homo sapiens
MAAAAPVAADDDERRRRPGAALEDSRSQEGANGEAESGELSRLRAELAGALAEMETMKAVAEVSESTKAEAVAAVQRQCQEEVASLQAILKDSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDTQWEQLQTEGRQLQKDLESVSRERDELQEGLRRSNEDCAKQMQVLLAQVQNSEQLLRTLQGTVSQAQERVQLQMAELVTTHKCLHHEVKRLNEENQGLRAEQLPSSAPQGSQQEQGEEESLPSSVPELQQLLCCTRQEARARLQAQEHGAERLRIEIVTLREALEEETVARASLEGQLRVQREETEVLEASLCSLRTEMERVQQEQSKAQLPDLLSEQRAKVLRLQAELETSEQVQRDFVRLSQALQVRLERIRQAETLEQVRSIMDEAPLTDVRDIKDT

SEQ ID NO: 60778 - protein, 498 aa, Homo sapiens
MAAAAPVAADDDERRRRPGADSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDTQWEQLQTEGRQLQKDLESVSRERDELQEGLRRSNEDCAKQMQVLLAQVQNSEQLLRTLQGTVSQAQERVQLQMAELVTTHKCLHHEVKRLNEENQGLRAEQLPSSAPQGSQQEQGEEESLPSSVPELQQLLCCTRQEARARLQAQEHGAERLRIEIVTLREALEEETVARASLEGQLRVQREETEVLEASLCSLRTEMERVQQEQSKAQLPDLLSEQRAKVLRLQAELETSEQVQRDFVRLSQALQVRLERIRQAETLEQVRSIMDEAPLTDVRDIKDT

SEQ ID NO: 60779 - protein, 694 aa, Homo sapiens
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPVSEPAAPEQPAPEPKHPARAPARGDSEDRRGPGQKTGPDPASAPGRGNYGPPVRRASEARMSSSSRDSESWDHSGGAGDSSRSPAGLRRANSVQASRPAPGSVQSPAPPQPGQPGTPGGSRPGPGPAGRFPDQKPEVAPSDPGTTAPPREERTGGVGGYPAVGAREDRMSHPSGPYSQASAAAPQPAAARQPPPPEEEEEEANSYDSDEATTLGALEFSLLYDQDNSSLQCTIIKAKGLKPMDSNGLADPYVKLHLLPGASKSNKLRTKTLRNTRNPIWNETLVYHGITDEDMQRKTLRISVCDEDKFGHNEFIGETRFSLKKLKPNQRKNFNICLERVIPMKRAGTTGSARGMALYEEEQVERVGDIEERGKILVSLMYSTQQGGLIVGIIRCVHLAAMDANGYSDPFVKLWLKPDMGKKAKHKTQIKKKTLNPEFNEEFFYDIKHSDLAKKSLDISVWDYDIGKSNDYIGGCQLGISAKGERLKHWYECLKNKDKKIERWHQLQNENHVSSD

SEQ ID NO: 60780 - protein, 694 aa, Homo sapiens; identical to SEQ ID NO: 60779

SEQ ID NO: 60781 - protein, 694 aa, Homo sapiens; identical to SEQ ID NO: 60779

SEQ ID NO: 60782 - protein, 645 aa, Homo sapiens
MTDTVFSNSSNRWMYPSDRPLQSKLKDRRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPVSEPAAPEQPAPEPKHPARAPARGDSEDRRGPGQKTGPDPASAPGRGNYGPPVRRASEARMSSSSRDSESWDHSGGAGDSSRSPAGLRRANSVQASRPAPGSVQSPAPPQPGQPGTPGGSRPGPGPAGRFPDQKPEVAPSDPGTTAPPREERTGGVGGYPAVGAREDRMSHPSGPYSQASAAAPQPAAARQPPPPEEEEEEANSYDSDEATTLGALEFSLLYDQDNSSLQCTIIKAKGLKPMDSNGLADPYVKLHLLPGASKSNKLRTKTLRNTRNPIWNETLVYHGITDEDMQRKTLRISVCDEDKFGHNEFIGETRFSLKKLKPNQRKNFNICLERVIPMKRAGTTGSARGMALYEEEQVERVGDIEERGKILVSLMYSTQQGGLIVGIIRCVHLAAMDANGYSDPFVKLWLKPDMGKKAKHKTQIKKKTLNPEFNEEFFYDIKHSDLAKKSLDISVWDYDIGKSNDYIGGCQLGISAKGERLKHWYECLKNKDKKIERWHQLQNENHVSSD

SEQ ID NO: 60783 - protein, 694 aa, Homo sapiens; identical to SEQ ID NO: 60779

SEQ ID NO: 60784 - protein, 12 aa, Homo sapiens
MTDTVFSNSSNR

SEQ ID NO: 60785 - protein, 83 aa, Homo sapiens
MTDTVFSNSSNRWMYPSDRPLQSNDKEQLQAGWSVHPGGQPDRQRKQEELTDEEKEIINRVIARAEKMEEMEQERIGRLVDRL

SEQ ID NO: 60786 - protein, 94 aa, Homo sapiens
MTDTVFSNSSNRWMYPSDRPLQSNDKEQLQAGWSVHPGGQPDRQRKQEELTDEEKEIINRVIARAEKMEEMEQERIGRLVDRLENMRKNVAGDG

SEQ ID NO: 60787 - protein, 163 aa, Homo sapiens
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPK

SEQ ID NO: 60788 - protein, 127 aa, Homo sapiens
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCG

SEQ ID NO: 60789 - protein, 104 aa, Homo sapiens
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQ

SEQ ID NO: 60790 - protein, 39 aa, Homo sapiens
MTDTVFSNSSNRWMYPSDRPLQSNDKEQLQAGWSVHPGG

SEQ ID NO: 60791 - protein, 115 aa, Homo sapiens
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVC

SEQ ID NO: 60792 - protein, 690 aa, Homo sapiens
MTDTVFSNSSNRWMYPSDRPLQSKLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPVSEPAAPEQPAPEPKHPARAPARGDSEDRRGPGQKTGPDPASAPGRGNYGPPVRRASEARMSSSSRDSESWDHSGGAGDSSRSPAGLRRANSVQASRPAPGSVQSPAPPQPGQPGTPGGSRPGPGPAGRFPDQKPEVAPSDPGTTAPPREERTGGVGGYPAVGAREDRMSHPSGPYSQASAAAPQPAAARQPPPPEEEEEEANSYDSDEATTLGALEFSLLYDQDNSSLQCTIIKAKGLKPMDSNGLADPYVKLHLLPGASKSNKLRTKTLRNTRNPIWNETLVYHGITDEDMQRKTLRISVCDEDKFGHNEFIGETRFSLKKLKPNQRKNFNICLERVIPMKRAGTTGSARGMALYEEEQVERVGDIEERGKILVSLMYSTQQGGLIVGIIRCVHLAAMDANGYSDPFVKLWLKPDMGKKAKHKTQIKKKTLNPEFNEEFFYDIKHSDLAKKSLDISVWDYDIGKSNDYIGGCQLGISAKGERLKHWYECLKNKDKKIERWHQLQNENHVSSD

SEQ ID NO: 60793 - protein, 125 aa, Homo sapiens
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTK

SEQ ID NO: 60794 - protein, 181 aa, Homo sapiens
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPV

SEQ ID NO: 60795 - protein, 94 aa, Homo sapiens; identical to SEQ ID NO: 60786

SEQ ID NO: 60796 - protein, 120 aa, Homo sapiens
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKK

SEQ ID NO: 60797 - protein, 134 aa, Homo sapiens
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRL

SEQ ID NO: 60798 - protein, 315 aa, Homo sapiens
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIEASPGQKRPLWLCKICSEQREVWKRSGAWFYKGLPKYILPLKTPGRADDPHFRPLPTEPAEREPRSSETSRIYTWARGRVVSSDSDSDSDLSSSSLEDRLPSTGVRDRKGDKPWKESGGSVEAPRMGFTHPPGHLSGCQSSLASGETGTGSADPPGGPRPGLTRRAPVKDTPGRAPAADAAPAGPSSCLG

SEQ ID NO: 60799 - protein, 286 aa, Homo sapiens
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKVWKRSGAWFYKGLPKYILPLKTPGRADDPHFRPLPTEPAEREPRSSETSRIYTWARGRVVSSDSDSDSDLSSSSLEDRLPSTGVRDRKGDKPWKESGGSVEAPRMGFTHPPGHLSGCQSSLASGETGTGSADPPGGPRPGLTRRAPVKDTPGRAPAADAAPAGPSSCLG

SEQ ID NO: 60800 - protein, 286 aa, Homo sapiens; identical to SEQ ID NO: 60799

SEQ ID NO: 60801 - protein, 776 aa, Homo sapiens
MNPEEQIVTWLISLGVLESPKKTICDPEEFLKSSLKNGVVLCKLINRLMPGSVEKFCLDPQTEADCINNINDFLKGCATLQVEIFDPDDLYSGVNFSKVLSTLLAVNKATEDQLSERPCGRSSSLSAANTSQTNPQGAVSSTVSGLQRQSKTVEMTENGSHQLIVKARFNFKQTNEDELSVCKGDIIYVTRVEEGGWWEGTLNGRTGWFPSNYVREIKSSERPLSPKAVKGFETAPLTKNYYTVVLQNILDTEKEYAKELQSLLVTYLRPLQSNNNLSTVEVTSLLGNFEEVCTFQQTLCQALEECSKFPENQHKVGGCLLSLMPHFKSMYLAYCANHPSAVNVLTQHSDELEQFMENQGASSPGILILTTNLSKPFMRLEKYVTLLQELERHMEDTHPDHQDILKAIVAFKTLMGQCQDLRKRKQLELQILSEPIQAWEGEDIKNLGNVIFMSQVMVQYGACEEKEERYLMLFSNVLIMLSASPRMSGFIYQGKIPIAGTVVTRLDEIEGNDCTFEITGNTVERIVVHCNNNQDFQEWLEQLNRLIRGPASCSSLSKTSSSSCSAHSSFSSTGQPRGPLEPPQIIKPWSLSCLRPAPPLRPSAALGYKERMSYILKESSKSPKTMKKFLHKRKTERKPSEEEYVIRKSTAALEEDAQILKVIEAYCTSANFQQGHGSSTRKDSIPQVLLPEEEKLIIEETRSNGQTIMEEKSLVDTVYALKDEVRELKQENKRMKQCLEEELKSRRDLEKLVRRLLKQTDECIRGESSSKTSILP

SEQ ID NO: 60802 - protein, 622 aa, Homo sapiens
MTENGSHQLIVKARFNFKQTNEDELSVCKGDIIYVTRVEEGGWWEGTLNGRTGWFPSNYVREIKSSERPLSPKAVKGFETAPLTKNYYTVVLQNILDTEKEYAKELQSLLVTYLRPLQSNNNLSTVEVTSLLGNFEEVCTFQQTLCQALEECSKFPENQHKVGGCLLSLMPHFKSMYLAYCANHPSAVNVLTQHSDELEQFMENQGASSPGILILTTNLSKPFMRLEKYVTLLQELERHMEDTHPDHQDILKAIVAFKTLMGQCQDLRKRKQLELQILSEPIQAWEGEDIKNLGNVIFMSQVMVQYGACEEKEERYLMLFSNVLIMLSASPRMSGFIYQGKIPIAGTVVTRLDEIEGNDCTFEITGNTVERIVVHCNNNQDFQEWLEQLNRLIRGPASCSSLSKTSSSSCSAHSSFSSTGQPRGPLEPPQIIKPWSLSCLRPAPPLRPSAALGYKERMSYILKESSKSPKTMKKFLHKRKTERKPSEEEYVIRKSTAALEEDAQILKVIEAYCTSANFQQGHGSSTRKDSIPQVLLPEEEKLIIEETRSNGQTIMEEKSLVDTVYALKDEVRELKQENKRMKQCLEEELKSRRDLEKLVRRLLKQTDECIRGESSSKTSILP

SEQ ID NO: 60803 - protein, 622 aa, Homo sapiens; identical to SEQ ID NO: 60802

SEQ ID NO: 60804 - protein, 649 aa, Homo sapiens
MTENGSHQLIVKARFNFKQTNEDELSVCKGDIIYVTRVEEGGWWEGTLNGRTGWFPSNYVREIKSSDGVSLLLPGLECNGAISAHHNLCLPGSKRPLSPKAVKGFETAPLTKNYYTVVLQNILDTEKEYAKELQSLLVTYLRPLQSNNNLSTVEVTSLLGNFEEVCTFQQTLCQALEECSKFPENQHKVGGCLLSLMPHFKSMYLAYCANHPSAVNVLTQHSDELEQFMENQGASSPGILILTTNLSKPFMRLEKYVTLLQELERHMEDTHPDHQDILKAIVAFKTLMGQCQDLRKRKQLELQILSEPIQAWEGEDIKNLGNVIFMSQVMVQYGACEEKEERYLMLFSNVLIMLSASPRMSGFIYQGKIPIAGTVVTRLDEIEGNDCTFEITGNTVERIVVHCNNNQDFQEWLEQLNRLIRGPASCSSLSKTSSSSCSAHSSFSSTGQPRGPLEPPQIIKPWSLSCLRPAPPLRPSAALGYKERMSYILKESSKSPKTMKKFLHKRKTERKPSEEEYVIRKSTAALEEDAQILKVIEAYCTSANFQQGHGSSTRKDSIPQVLLPEEEKLIIEETRSNGQTIMEEKSLVDTVYALKDEVRELKQENKRMKQCLEEELKSRRDLEKLVRRLLKQTDECIRGESSSKTSILP

SEQ ID NO: 60805 - protein, 622 aa, Homo sapiens
MTENGSHQLIVKARFNFKQTNEDELSVCKGDIIYVTRVEEGGWWEGTLNGRTGWFPSNYVREIKSSERPLSPKAVKGFETAPLTKNYYTVVLQNILDTEKEYAKELQSLLVTYLRPLQSNNNLSTVEVTSLLGNFEEVCTFQQTLCQALEECSKFPENQHKVGGCLLSLMPHFKSMYLAYCANHPSAVNVLTQHSDELEQFMENQGASSPGILILTTNLSKPFMRLEKYVTLLQELERHMEDTHPDHQDILKAIVAFKTLMGQCQDLRKRKQLELQILSEPIQAWEGEDIKNLGNVIFMSQVMVQYGACEEKEERYLMLFSNVLIMLSASPRMSGFIYQGKIPIAGTVVTRLDEIEGNDCTFEITGNTVERIVVHCNNNQDFQEWLEQLNRLIRGPASCSSLSKTSSSSCSAHSSFSSTGQPRGPLEPPQIIKPWSLSCLRPAPPLRPSAALGYKEAFTFVFEESSKSPKTMKKFLHKRKTERKPSEEEYVIRKSTAALEEDAQILKVIEAYCTSANFQQGHGSSTRKDSIPQVLLPEEEKLIIEETRSNGQTIMEEKSLVDTVYALKDEVRELKQENKRMKQCLEEELKSRRDLEKLVRRLLKQTDECIRGESSSKTSILP

SEQ ID NO: 60806 - protein, 631 aa, Homo sapiens
MFYAHFVLSKRGPLAKIWLAAHWDKKLTKAHVFECNLESSVESIISPKVKMALRTSGHLLLGVVRIYHRKAKYLLADCNEAFIKIKMAFRPGVVDLPEENREAAYNAITLPEEFHDFDQPLPDLDDIDVAQQFSLNQSRVEEITMREEVGNISILQENDFGDFGMDDREIMREGSAFEDDDMLVSTTTSNLLLESEQSTSNLNEKINHLEYEDQYKDDNFGEGNDGGILDDKLISNNDGGIFDDPPALSEAGVMLPEQPAHDDMDEDDNVSMGGPDSPDSVDPVEPMPTMTDQTTLVPNEEEAFALEPIDITVKETKAKRKRKLIVDSVKELDSKTIRAQLSDYSDIVTTLDLAPPTKKLMMWKETGGVEKLFSLPAQPLWNNRLLKLFTRCLTPLVPEDLRKRRKGGEADNLDEFLKEFENPEVPREDQQQQHQQRDVIDEPIIEEPSRLQESVMEASRTNIDESAMPPPPPQGVKRKAGQIDPEPVMPPQQVEQMEIPPVELPPEEPPNICQLIPELELLPEKEKEKEKEKEDDEEEEDEDASGGDQDQEERRWNKRTQQMLHGLQRALAKTGAESISLLELCRNTNRKQAAAKFYSFLVLKKQQAIELTQEEPYSDIIATPGPRFHII

SEQ ID NO: 60807 - protein, 352 aa, Homo sapiens
MVRPVRHKKPVNYSQFDHSDSDDDFVSATVPLNKKSRTAPKELKQDKPKPNLNNLRKEEIPVQEKTPKKRLPEGTFSIPASAVPCTKMALDDKLYQRDLEVALALSVKELPTVTTNVQNSQDKSIEKHGSSKIETMNKSPHISNCSVASDYLDLDKITVEDDVGGVQGKRKAASKAAAQQRKILLEGSDGDSANDTEPDFAPGEDSEDDSDFCESEDNDEDFSMRKSKVKEIKKKEVKVKSPVEKKEKKSKSKCNALVTSVDSAPAAVKSESQSLPKKVSLSSDTTRKPLEIRSPSAESKKPKWVPPAASGGSRSSSSPLVVVSVKSPNQSLRLGLSRLARVKPLHPNATST

SEQ ID NO: 60808 - protein, 302 aa, Homo sapiens
MVRPVRHKKPVNYSQFDHSDSDDDFVSATVPLNKKSRTAPKELKQDKPKPNLNNLRKEEIPVQEKTPKKRLPEGTFSIPASAVPCTKMALDDKLYQRDLEVALALSVKELPTVTTNVQNSQDKSIEKHGSSKIETMNKSPHISNCSVASDYLDLDKITVEDDVGGVQGKRKAASKAAAQQRKILLEGSDGDSANDTEPDFAPGEDSEDDSDFCESEDNDEDFSMRKSKVKEIKKKEVKVKSPVEKKEKKSKSKCNALAASGGSRSSSSPLVVVSVKSPNQSLRLGLSRLARVKPLHPNATST

SEQ ID NO: 60809 - protein, 335 aa, Homo sapiens
MVRPVRHKKPVNYSQFDHSDSDDDFVSATVPLNKKSRTAPKELKQDKPKPNLNNLRKEEIPVQEKTPKKRMALDDKLYQRDLEVALALSVKELPTVTTNVQNSQDKSIEKHGSSKIETMNKSPHISNCSVASDYLDLDKITVEDDVGGVQGKRKAASKAAAQQRKILLEGSDGDSANDTEPDFAPGEDSEDDSDFCESEDNDEDFSMRKSKVKEIKKKEVKVKSPVEKKEKKSKSKCNALVTSVDSAPAAVKSESQSLPKKVSLSSDTTRKPLEIRSPSAESKKPKWVPPAASGGSRSSSSPLVVVSVKSPNQSLRLGLSRLARVKPLHPNATST

SEQ ID NO: 60810 - protein, 233 aa, Homo sapiens
MNKSPHISNCSVASDYLDLDKITVEDDVGGVQGKRKAASKAAAQQRKILLEGSDGDSANDTEPDFAPGEDSEDDSDFCESEDNDEDFSMRKSKVKEIKKKEVKVKSPVEKKEKKSKSKCNALVTSVDSAPAAVKSESQSLPKKVSLSSDTTRKPLEIRSPSAESKKPKWVPPGMAYLSSRTGAWKIITAASGGSRSSSSPLVVVSVKSPNQSLRLGLSRLARVKPLHPNATST

SEQ ID NO: 60811 - protein, 135 aa, Homo sapiens
MRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLW

SEQ ID NO: 60812 - protein, 284 aa, Homo sapiens
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEGPLSFLMKRKTAQKLAIQKALSDAFQKLLIVVLESGKIAVEYRPSEDIVGVRCEEELHGLIQVPCSPWKQYGQEEEGYLSDFSLEEEEFRLPELD

SEQ ID NO: 60813 - protein, 116 aa, Homo sapiens
MHLLVPPPQHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKDHYHSL

SEQ ID NO: 60814 - protein, 236 aa, Homo sapiens
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEGPLSFLMKRKTAQKLAIQKALSDAFQKLLIVVLGKTVLIILEVLQFQ

SEQ ID NO: 60815 - protein, 261 aa, Homo sapiens
MHLLVPPPQHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEGPLSFLMKRKTAQKLAIQKALSDAFQKLLIVVLESGKIAVEYRPSEDIVGVRCEEELHGLIQVPCSPWKQYGQEEEGYLSDFSLEEEEFRLPELD

SEQ ID NO: 60816 - protein, 130 aa, Homo sapiens
FGFNGCSKRIIKLQELSDLEERENEDSMVPLPKQSLKFFCALEVVLPSCDCRSPGIGLVEEPMDKVEEESGKIAVEYRPSEDIVGVRCEEELHGLIQVPCSPWKQYGQEEEGYLSDFSLEEEEFRLPELD

SEQ ID NO: 60817 - protein, 166 aa, Homo sapiens
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKVPCSPWKQYGQEEEGYLSDFSLEEEEFRLPELD

SEQ ID NO: 60818 - protein, 213 aa, Homo sapiens
MHLLVPPPQHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEGPLSFLMKRKTAQKLAIQKALSDAFQKLLIVVLGKTVLIILEVLQFQ

SEQ ID NO: 60819 - protein, 251 aa, Homo sapiens
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEESGKIAVEYRPSEDIVGVRCEEELHGLIQVPCSPWKQYGQEEEGYLSDFSLEEEEFRLPELD

SEQ ID NO: 60820 - protein, 139 aa, Homo sapiens
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKDHYHSL

SEQ ID NO: 60821 - protein, 143 aa, Homo sapiens
MHLLVPPPQHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKVPCSPWKQYGQEEEGYLSDFSLEEEEFRLPELD

SEQ ID NO: 60822 - protein, 910 aa, Homo sapiens
MRRSAAPSQLQGNSFKKPKFIPPGRSNPGLNEEITKLNPDIKLFEGVAINNTFLPSQNDLRICSLNLPSEESTREINNRDNCSGKYCFEAPTLATLDPPHTVHSAPKEVAVSKEQEEKSDSLVKYFSVVWCKPSKKKHKKWEGDAVLIVKGKSFILKNLEGKDIGRGIGYKFKELEKIEEGQTLMICGKEIEVMGVISPDDFSSGRCFQLGGGSTAISHSSQVARKCFSNPFKSVCKPSSKENRQNDFQNCKPRHDPYTPNSLVMPRPDKNHQWVFNKNCFPLVDVVIDPYLVYHLRPHQKEGIIFLYECVMGMRMNGRCGAILADEMGLGKTLQCISLIWTLQCQGPYGGKPVIKKTLIVTPGSLVNNWKKEFQKWLGSERIKIFTVDQDHKVEEFIKSIFYSVLIISYEMLLRSLDQIKNIKFDLLICDEGHRLKNSAIKTTTALISLSCEKRIILTGTPIQNDLQEFFALIDFVNPGILGSLSSYRKIYEEPIILSREPSASEEEKELGERRAAELTCLTGLFILRRTQEIINKYLPPKIENVVFCRPGALQIELYRKLLNSQVVRFCLQGLLENSPHLICIGALKKLCNHPCLLFNSIKEKECSSTCDKNEEKSLYKGLLSVFPADYNPLLFTEKESGKLQVLSKLLAVIHELRPTEKVVLVSNYTQTLNILQEVCKRHGYAYTRLDGQTPISQRQQIVDGFNSQHSSFFIFLLSSKAGGVGLNLIGGSHLILYDIDWNPATDIQAMSRVWRDGQKYPVHIYRLLTTGTIEEKIYQRQISKQGLCGAVVDLTKTSEHIQFSVEELKNLFTLHESSDCVTHDLLDCECTGEEVHTGDSLEKFIVSRDCQLGPHHQKSNSLKPLSMSQLKQWKHFSGDHLNLTDPFLERITENVSFIFQNITTQATGT

SEQ ID NO: 60823 - protein, 299 aa, Homo sapiens
MVGKARSSNFTLSEKLDLLKLVKPYVKILEEHTNKHSVIVEKNRCWDIIAVNYNAIGVDRPPRTAQGLRTLYKRLKEYAKQELLQQKETQSDFKSNISEPTKKVMEMIPQISSFCLVRDRNHIQSANLDEEAQAGTSSLQVMLDHHPVAITVEVKQEEDIKPPPPLVLNSQQSDTLEQREEHELVHVMERSLSPSLSSVDMRMTSSPSSIPRRDDFFRHESGEHFRSLLGYDPQILQMLKEEHQIILENQKNFGLYVQEKRDGLKRRQQLEEELLRAKIEVEKLKAIRLRHDLPEYNSL

SEQ ID NO: 60824 - protein, 125 aa, Homo sapiens
MRRSAAPSQLQGNSFKKPKFIPPGRSNPGLNEEITKLNPDIKLFEGVAINNTFLPSQNDLRICSLNLPSEESTREINNRDNCSGKYCFEAPTLATLDPPHTVHSAPKEVAVSKEQEEKSDSLVKY

SEQ ID NO: 60825 - protein, 117 aa, Homo sapiens
MRRSAAPSQLQGNSFKKPKFIPPGRSNPGLNEEITKLNPDIKLFEGVAINNTFLPSQNDLRICSLNLPSEESTREINNRDNCSGKYCFEAPTLATLDPPHTVQTWMRRHRLVPVHYR

SEQ ID NO: 60826 - protein, 158 aa, Homo sapiens
MLDHHPVAITVEVKQEEDIKPPPPLVLNSQQSDTLEQREEHELVHVMERSLSPSLSSVDMRMTSSPSSIPRRDDFFRHESGEHFRSLLGYDPQILQMLKEEHQIILENQKNFGLYVQEKRDGLKRRQQLEEELLRAKIEVEKLKAIRLRHDLPEYNSL

SEQ ID NO: 60827 - protein, 582 aa, Homo sapiens
MGLGKTLQCISLIWTLQCQGPYGGKPVIKKTLIVTPGSLVNNWKKEFQKWLGSERIKIFTVDQDHKVEEFIKSIFYSVLIISYEMLLRSLDQIKNIKFDLLICDEGHRLKNSAIKTTTALISLSCEKRIILTGTPIQNDLQEFFALIDFVNPGILGSLSSYRKIYEEPIILSREPSASEEEKELGEREQLNLLASLDSLLRRTQEIINKYLPPKIENVVFCRPGALQIELYRKLLNSQVVRFCLQGLLENSPHLICIGALKKLCNHPCLLFNSIKEKECSSTCDKNEEKSLYKGLLSVFPADYNPLLFTEKESGKLQVLSKLLAVIHELRPTEKVVLVSNYTQTLNILQEVCKRHGYAYTRLDGQTPISQRQQIVDGFNSQHSSFFIFLLSSKAGGVGLNLIGGSHLILYDIDWNPATDIQAMSRVWRDGQKYPVHIYRLLTTGTIEEKIYQRQISKQGLCGAVVDLTKTSEHIQFSVEELKNLFTLHESSDCVTHDLLDCECTGEEVHTGDSLEKFIVSRDCQLGPHHQKSNSLKPLSMSQLKQWKHFSGDHLNLTDPFLERITENVSFIFQNITTQATGT

SEQ ID NO: 60828 - protein, 429 aa, Homo sapiens
MAAMLKCVMSGSQVKVFGKAVQALSRISDEFWLDPSKKGLALRCVNSSRSAYGCVLFSPVFFQHYQWSALVKMSENELDTTLHLKCKLGMKSILPIFRCLNSLERNIEKCRIFTRSDKCKVVIQFFYRHGIKRTHNICFQESQPLQVIFDKNVCTNTLMIQPRLLADAIVLFTSSQEEVTLAVTPLNFCLKSSNEESMDLSNAVHSEMFVGSDEFDFFQIGMDTEITFCFKELKGILTFSEATHAPISIYFDFPGKPLALSIDDMLVEANFILATLADEQSRASSPQSLCLSQKRKRSDLIEKKAGKNVTGQALECISKKAAPRRLYPKETLTNISALENCGSPAMKRVDGDVSEVSESSVSNTEEVPGSLCLRKFSCMFFGAVSSDQQEHFNHPFDSLARASDSEEDMNNVCCRKEFNGSDAKYFCII

SEQ ID NO: 60829 - protein, 345 aa, Homo sapiens
MSENELDTTLHLKCKLGMKSILPIFRCLNSLERNIEKCRIFTRSDKCKVVIQFFYRHGIKRTHNICFQESQPLQVIFDKNVCTNTLMIQPRLLADAIVLFTSSQEEVTLAVTPLNFCLKSSNEESMDLSNAVHSEMFVGSDEFDFFQIGMDTEITFCFKELKGILTFSEATHAPISIYFDFPGKPLALSIDDMLVEANFILATLADEQSRASSPQSLCLSQKRKRSDLIEKKAGKNVTGQALECISKKAAPRRLYPKETLTNISALENCGSPAMKRVDGDVSEVSESSVSNTEEVPGSLCLRKFSCMFFGAVSSDQQEHFNHPFDSLARASDSEEDMNNGSFSIF

SEQ ID NO: 60830 - protein, 345 aa, Homo sapiens; identical to SEQ ID NO: 60829

SEQ ID NO: 60831 - protein, 716 aa, Homo sapiens
MEDSTSPKQEKENQEELGETRRPWEGKTAASPQYSEPESSEPLEAKQGPETGRQSRSSRPWSPQSRAKTPLGGPAGPETSSPAPVSPREPSSSPSPLAPARQDLAAPPQSDRTTSVIPEAGTPYPDPLEQSSDKRESTPHHTSQSEGNTFQQSQQPKPHLCGRRDVSYNNAKQKELRFDVFQEEDSNSDYDLQQPAPGGSEVAPSMLEITIQNAKAYLLKTSSNSGFNLYDHLSNMLTKILNERPENAVDIFENISQDVKMAHFSKKFDALQNENELLPTYEIAEKQKALFLQGHLEGVDQELEDEIAENALPNVMESAFYFEQAGVGLGTDETYRIFLALKQLTDTHPIQRCRFWGKILGLEMNYIVAEVEFREGEDEEEVEEEDVAEERDNGESEAHEDEEDELPKSFYKAPQAIPKEESRTGANKYVYFVCNEPGRPWVKLPPVIPAQIVIARKIKKFFTGRLDAPIISYPPFPGNESNYLRAQIARISAGTHVSPLGFYQFGEEEGEEEEEAEGGRNSFEENPDFEGIQVIDLVESLSNWVHHVQHILSQGRCNWFNSIQKNEEEEEEEDEEKDDSDYIEQEVGLPLLTPISEDLEIQNIPPWTTRLSSNLIPQYAIAVLQSNLWPGAYAFSNGKKFENFYIGWGHKYSPDNYTPPVPPPVYQEYPSGPEITEMDDPSVEEEQAFRAAQEAVLLAAENEESEEDEDEEDDYD

SEQ ID NO: 60832 - protein, 469 aa, Homo sapiens
MEDSTSPKQEKENQEELGETRRPWEGKTAASPQYSEPESSEPLEAKQGPETGRQSRSSRPWSPQSRAKTPLGGPAGPETSSPAPVSPREPSSSPSPLAPARQDLAAPPQSDRTTSVIPEAGTPYPDPLEQSSDKRESTPHHTSQSEGNTFQQSQQPKPHLCGRRDVSYNNAKQKELRFDVFQEEDSNSDYDLQQPAPGGSEVAPSMLEITIQNAKAYLLKTSSNSGFNLYDHLSNMLTKILNERPENAVDIFENISQDVKMAHFSKKFDALQNENELLPTYEIAEKQKALFLQGHLEGVDQELEDEIGRCNWFNSIQKNEEEEEEEDEEKDDSDYIEQEVGLPLLTPISEDLEIQNIPPWTTRLSSNLIPQYAIAVLQSNLWPGAYAFSNGKKFENFYIGWGHKYSPDNYTPPVPPPVYQEYPSGPEITEMDDPSVEEEQAFRAAQEAVLLAAENEESEEDEDEEDDYD

SEQ ID NO: 60833 - protein, 600 aa, Homo sapiens
MEDSTSPKQEKENQEELGETRRPWEGKTAASPQYSEPESSEPLEAKQGPETGRQSRSSRPWSPQSRAKTPLGGPAGPETSSPAPVSPREPSSSPSPLAPARQDLAAPPQSDRTTSVIPEAGTPYPDPLEQSSDKRESTPHHTSQSEGNTFQQSQQPKPHLCGRRDVSYNNAKQKELRFDVFQEEDSNSDYDLQQPAPGGSEVAPSMLEITIQNAKAYLLKTSSNSGFNLYDHLSNMLTKILNERPENAVDIFENISQDVKMAHFSKKFDALQNENELLPTYEIAEKQKALFLQGHLEGVDQELEDEIAENALPNVMESAFYFEQAGVGLGTDETYRIFLALKQLTDTHPIQRCRFWGKILGLEMNYIVAEVEFREGEDEEEVEEEDVAEERDNGESEAHEDEEDELPKSFYKAPQAIPKEESRTGANKYVYFVCNEPGRPWVKLPPVIPAQIVIARKIKKFFTGRLDAPIISYPPFPGNESNYLRAQIARISAGTHVSPLGFYQFGEEEGEEEEEAEGGRNSFEENPDFEGIQVIDLVESLSNWVHHVQHILSQRFRIYPPGQHGYPQISFHNMLLQSFNPTFGLEHMPSPMAKSLKIST

SEQ ID NO: 60834 - protein, 511 aa, Homo sapiens
MLEITIQNAKAYLLKTSSNSGFNLYDHLSNMLTKILNERPENAVDIFENISQDVKMAHFSKKFDALQNENELLPTYEIAEKQKALFLQGHLEGVDQELEDEIAENALPNVMESAFYFEQAGVGLGTDETYRIFLALKQLTDTHPIQRCRFWGKILGLEMNYIVAEVEFREGEDEEEVEEEDVAEERDNGESEAHEDEEDELPKSFYKAPQAIPKEESRTGANKYVYFVCNEPGRPWVKLPPVIPAQIVIARKIKKFFTGRLDAPIISYPPFPGNESNYLRAQIARISAGTHVSPLGFYQFGEEEGEEEEEAEGGRNSFEENPDFEGIQVIDLVESLSNWVHHVQHILSQGRCNWFNSIQKNEEEEEEEDEEKDDSDYIEQEVGLPLLTPISEDLEIQNIPPWTTRLSSNLIPQYAIAVLQSNLWPGAYAFSNGKKFENFYIGWGHKYSPDNYTPPVPPPVYQEYPSGPEITEMDDPSVEEEQAFRAAQEAVLLAAENEESEEDEDEEDDYD

SEQ ID NO: 60835 - protein, 176 aa, Homo sapiens
MLVKRDYRYDRVLFWGRILGLVADYYIAQGLSEDQLAPRKTLYSLNCTEWSLLPPATEEMVAQSSVVKGRFMGDPSYEYEHTELQKVNEGEKVFEEEIVVQIKEETRLVSVIDQIDKAVAIIPRGALFKTPFGPTHVNRTFEGYYNWYKTPAPHPTCDGNQGVRARGRSPSLGRFL

SEQ ID NO: 60836 - protein, 276 aa, Homo sapiens
MDADSLLLSLELASGSGQGLSPDRRASLLTSLMLVKRDYRYDRVLFWGRILGLVADYYIAQGLSEDQLAPRKTLYSLNCTEWSLLPPATEEMVAQSSVVKGRFMGDPSYEYEHTELQKVNEGEKVFEEEIVVQIKEETRLVSVIDQIDKAVAIIPRGALFKTPFGPTHVNRTFEGLSLSEAKKLSSYFHFREPVELKNKTLLEKADLDPSLDFMDSLEHDIPKGSWSIQMERGNALVVLRSLLWPGLTFYHAPRTKNYGYVYVGTGEKNMDLPFML

SEQ ID NO: 60837 - protein, 306 aa, Homo sapiens
MDADSLLLSLELASGSGQGLSPDRRASLLTSLMLVKRDYRYDRVLFWGRILGLVADYYIAQGLSEDQLAPRKTLYSLNCTEWSLLPPATEEMVAQSSVVKGRFMGDPSYEYEHTELQKVNEGEKVFEEEIVIDKAVAIIPRGALFKTPFGPTHVNRTFEGLSLSEAKKLSSYFHFREPVELKNKTLLEKADLDPSLDFMDSLEHDIPKGSEAVVQGDFTWLLSRCGFGWPCSWDSCSVSMRVLEHPDGEGQCPGGAAQPALAGPHLLPCSPHQELWLRLRGHWREEHGLALHAIEWEPAWMFLNRV

SEQ ID NO: 60838 - protein, 133 aa, Homo sapiens
  MOD_RES (1)..(1): Any amino acid
XLNCTEWSLLPPATEEMVAQSSVVKGRFMGDPSYEYEHTELQKVNEGEKVFEEEIVVQIKEETRLVSVIDQIDKAVAIIPRGALFKTPFGPTHVNRTFEGYYNWYKTPAPHPTCDGNQGVRARGRSPSLGRFL

SEQ ID NO: 60839 - protein, 361 aa, Homo sapiens
MWVLTPAAFAGKLLSVFRQPLSSLWRSLVPLFCWLRATFWLLATKRRKQQLVLRGPDETKEEEEDPPLPTTPTSVNYHFTRQCNYKCGFCFHTAKTSFVLPLEEAKRGLLLLKEAGMEKINFSGGEPFLQDRGEYLGKLVRFCKVELRLPSVSIVSNGSLIRERWFQNYGEYLDILAISCDSFDEEVNVLIGRGQGKKNHVENLQKLRRWCRDYRVAFKINSVINRFNVEEDMTEQIKALNPVRWKVFQCLLIEGENCGEDALREAERFVIGDEEFERFLERHKEVSCLVPESNQKMKDSYLILDEYMRFLNCRKGRKDPSKSILDVGVEEAIKFSGFDEKMFLKRGGKYIWSKADLKLDW

SEQ ID NO: 60840 - protein, 254 aa, Homo sapiens [sequence omitted]

SEQ ID NO: 60841 - protein, 557 aa, Homo sapiens
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAGPSAGSGSARFSRRPTCPDTSVAGSLPTPPVPRHRKSHSLGNNMMCQLSVVESKSATFPSEKARHLLDDSVLESRSPRRGLALTSSSAVTNGLSLGSSESSEFSEEMSSGLESPTGPCICSLGNSAAVPTMEGPLRRKTLLKEGRKPALSSWTRYWVILSGSTLLYYGAKSLRGTDRKHYKSTPGKKVSIVGWMVQLPDDPEHPDIFQLNNPDKGNVYKFQTGSRFHAILWHKHLDDACKSNRPQVPANLMSFE

SEQ ID NO: 60842 - protein, 173 aa, Homo sapiens
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQKLLELNNLHSLMSVVSALQSAPIFRLTKTWALLNRKDKTTFEKLDYLMSKEDNYKRTREYIRSLKMVPSIPYL

SEQ ID NO: 60843 - protein, 529 aa, Homo sapiens
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAGPSAGSGSARFSRRPTCPDTSVAGSLPTPPVPRHRKSHSLGNNRGRLYATLGPNWRVPVRNSPRTRSCVYSPTGPCICSLGNSAAVPTMEGPLRRKTLLKEGRKPALSSWTRYWVILSGSTLLYYGAKSLRGTDRKHVSIVGWMVQLPDDPEHPDIFQLNNPDKGNVYKFQTGSRFHAILWHKHLDDACKSNRPQEAGAAPGPTGTDSHEVDHLEGGAGKEAGPCA

SEQ ID NO: 60844 - protein, 305 aa, Homo sapiens
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAAM

SEQ ID NO: 60845 - protein, 213 aa, Homo sapiens
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGRSLNWLIFF

SEQ ID NO: 60846 - protein, 108 aa, Homo sapiens
MYKRNGLMASVLVTSATPQGSSSSDSLEGQSCDYASKSYDAVVFDVLKVTPEEFASQITLMDIPVFKAIQPEKGWPARMEDSLQKSTVSSRPHDTLQFRKTLPVGPGT

SEQ ID NO: 60847 - protein, 384 aa, Homo sapiens
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAVSHLSSLSHQGQAEEARLKPTSGQHPAWMWPSSSRVPAAPPASAAPRSPWPRNLRNDQGQPGAVALTCNPSTLGSRSRRIT

SEQ ID NO: 60848 - protein, 537 aa, Homo sapiens
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAGPSAGSGSARFSRRPTCPDTSVAGSLPTPPVPRHRKSHSLGNNRGRLYATLGPNWRVPVRNSPRTRSCVYSPTGPCICSLGNSAAVPTMEGPLRRKTLLKEGRKPALSSWTRYWVILSGSTLLYYGAKSLRGTDRKHYKSTPGKKVSIVGWMVQLPDDPEHPDIFQLNNPDKGNVYKFQTGSRFHAILWHKHLDDACKSNRPQEAGAAPGPTGTDSHEVDHLEGGAGKEAGPCA

SEQ ID NO: 60849 - protein, 153 aa, Homo sapiens
  MOD_RES (1)..(1): Any amino acid
XNSPRTRSCVYSPTGPCICSLGNSAAVPTMEGPLRRKTLLKEGRKPALSSWTRYWVILSGSTLLYYGAKSLRGTDRKHYKSTPGKKVSIVGWMVQLPDDPEHPDIFQLNNPDKGNVYKFQTGSRFHAILWHKHLDDACKSNRPQVPANLMSFE

SEQ ID NO: 60850 - protein, 2083 aa, Homo sapiens
MFSKKPHGDVKKSTQKVLDTKKDALTRLKHLRIVIENAESIDLKQFFDQHFSHIYYVFFENFVTIEASLKQKGHKSQREELDAILFIFEKILQLLPERIHQRWQFHSIGLILKKLLHTGNSLKIRREGVRLFLLWLQALQNNCSKEQLWMFSCLIPGFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVAMRSRSIGECALPSAYIRSAKSAPVLIHTSKPFLPDIVLTPLSDELSDIDDAQILPRSTRVRHFSQSEETGNEVFGALNEEQPLPRSSSTSDILEPFTVERAKVNKEDMSQKLPPLNSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGSESASPVHSPLGSRSQTPSPSTLNIDHMEQKDLQLDEKLHHSVLQTPDDLEISEFPSECCSVMAGGTLTGWHADVATVMWRRMLGILGDVNSIMDPEIHAQVFDYLCELWQNLAKIRDNLGISTDNLTSPSPPVLIPPLRILTPWLFKATMLTDKYKQGKLHAYKLICNTMKRRQDVSPNRDFLTHFYNIMHCGLLHIDQDIVNTIIKHCSPQFFSLGLPGATMLIMDFIVAAGRVASSAFLNAPRVEAQVLLGSLVCFPNLYCELPSLHPNIPDVAVSQFTDVKELIIKTVLSSARDEPSGPARCVALCSLGIWICEELVHESHHPQIKEALNVICVSLKFTNKTVAHVACNMLHMLVHYVPRLQIYQPDSPLKIIQILIATITHLLPSTEASSYEMDKRLVVSLLLCLLDWIMALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDADH

SEQ ID NO: 60851 - protein, 2083 aa, Homo sapiens
MFSKKPHGDVKKSTQKVLDTKKDALTRLKHLRIVIENAESIDLKQFFDQHFSHIYYVFFENFVTIEASLKQKGHKSQREELDAILFIFEKILQLLPERIHQRWQFHSIGLILKKLLHTGNSLKIRREGVRLFLLWLQALQNNCSKEQLWMFSCLIPGFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVDIDDAQILPRSTRVRHFSQSEETGNEVFGALNEEQPLPRSSSTSDILEPFTVERAKVNKEDMSQKLPPLNSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGSESASPVHSPLGSRSQTPSPSTLNIDHMEQKDLQLDEKLHHSVLQTPDDLEISEFPSECCSVMAGGTLTGWHADVATVMWRRMLGILGDVNSIMDPEIHAQVFDYLCELWQNLAKIRDNLGISTDNLTSPSPPVLIPPLRILTPWLFKATMLTDKYKQGKLHAYKLICNTMKRRQDVSPNRDFLTHFYNIMHCGLLHIDQDIVNTIIKHCSPQFFSLGLPGATMLIMDFIVAAGRVASSAFLNAPRVEAQVLLGSLVCFPNLYCELPSLHPNIPDVAVSQFTDVKELIIKTVLSSARDEPSGPARCVALCSLGIWICEELVHESHHPQIKEALNVICVSLKFTNKTVAHVACNMLHMLVHYVPRLQIYQPDSPLKIIQILIATITHLLPSTEASSYEMDKRLVVSLLLCLLDWIMALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDAGSYPEILPSETPTATQVDGADLASPMSPRTSKSRMSMKLRRSSGSANKS

SEQ ID NO: 60852 - protein, 2073 aa, Homo sapiens
MFSKKPHGDVKKSTQKVLDTKKDALTRLKHLRIVIENAESIDLKQFFDQHFSHIYYVFFENFVTIEASLKQKGHKSQREELDAILFIFEKILQLLPERIHQRWQFHSIGLILKKLLHTGNSLKIRREGVRLFLLWLQALQNNCSKEQLWMFSCLIPGFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVDIDDAQILPRSTRVRHFSQSEETGNEVFGALNEEQPLPRSSSTSDILEPFTVERAKVNKEDMSQKLPPLNSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGSESASPVHSPLGSRSQTPSPSTLNIDHMEQKDLQLDEKLHHSVLQTPDDLEISEFPSECCSVMAGGTLTGWHADVATVMWRRMLGILGDVNSIMDPEIHAQVFDYLCELWQNLAKIRDNLGISTDNLTSPSPPVLIPPLRILTPWLFKATMLTDKYKQGKLHAYKLICNTMKRRQDVSPNRDFLTHFYNIMHCGLLHIDQDIVNTIIKHCSPQFFSLGLPGATMLIMDFIVAAGRVASSAFLNAPRVEAQVLLGSLVCFPNLYCELPSLHPNIPDVAVSQFTDVKELIIKTVLSSARDEPSGPARCVALCSLGIWICEELVHESHHPQIKEALNVICVSLKFTNKTVAHVACNMLHMLVHYVPRLQIYQPDSPLKIIQILIATITHLLPSTEASSYEMDKRLVVSLLLCLLDWIMALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDAEERNAVIVLFLPKPPLENIGHLKAPTQRFYPVKLPQQRR

SEQ ID NO: 60853 - protein, 2049 aa, Homo sapiens
MFSKKPHGDVKKSTQKVLDTKKDALTRLKHLRIVIENAESIDLKQFFDQHFSHIYYVFFENFVTIEASLKQKGHKSQREELDAILFIFEKILQLLPERIHQRWQFHSIGLILKKLLHTGNSLKIRREGVRLFLLWLQALQNNCSKEQLWMFSCLIPGFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVDIDDAQILPRSTRVRHFSQSEETGNEVFGALNEEQPLPRSSSTSDILEPFTVERAKEAEQNATRGSTEGSVQSCNGLFWKESCSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGSESASPVHSPLGSRSQTPSPSTLNIDHMEQKDLQLDEKLHHSVLQTPDDLEISEFPSECCSVMAGGTLTGWHADVATVMWRRMLGILGDVNSIMDPEIHAQVFDYLCELWQNLAKIRDNLGISTDNLTSPSPPVLIPPLRILTPWLFKATMLTDKYKQGKLHAYKLICNTMKRRQDVSPNRDFLTHFYNIMHCGLLHIDQDIVNTIIKHCSPQFFSLGLPGATMLIMDFIVAAGRVASSAFLNAPRVEAQVLLGSLVCFPNLYCELPSLHPNIPDVAVSQFTDVKELIIKTVLSSARDEPSGPARCVALCSLGIWICEELVHESHHPQIKEALNVICVSLKFTNKTVAHVACNMLHMLVHYVPRLQIYQPDSPLKIIQILIATITHLLPSTEASSYEMDKRLVVSLLLCLLDWIMALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDADH

SEQ ID NO: 60854 - protein, 2036 aa, Homo sapiens
MFSKKPHGDVKKSTQKVLDTKKDALTRLKHLRIVIENAESIDLKQFFDQHFSHIYYVFFENFVTIEASLKQKGHKSQREELDAILFIFEKILQLLPERIHQRWQFHSIGLILKKLLHTGNSLKIRREGVRLFLLWLQALQNNCSKEQLWMFSCLIPGFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVDIDDAQILPRSTRVRHFSQSEETGNEVFGALNEEQPLPRSSSTSDILEPFTVERAKVNKEDMSQKLPPLNSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGSESASPVHSPLGSRSQTPSPSTLNIDHMEQKDLQLDEKLHHSVLQTPDDLEISEFPSECCSVMAGGTLTGWHADVATVMWRRMLGILGDVNSIMDPEIHAQVFDYLCELWQNLAKIRDNLGISTDNLTSPSPPVLIPPLRILTPWLFKATMLTDKYKQGKLHAYKLICNTMKRRQDVSPNRDFLTHFYNIMHCGLLHIDQDIVNTIIKHCSPQFFSLGLPGATMLIMDFIVAAGRVASSAFLNAPRVEAQVLLGSLVCFPNLYCELPSLHPNIPDVAVSQFTDVKELIIKTVLSSARDEPSGPARCVALCSLGIWICEELVHESHHPQIKEALNVICVSLKFTNKTVAHVACNMLHMLVHYVPRLQIYQPDSPLKIIQILIATITHLLPSTEASSYEMDKRLVVSLLLCLLDWIMALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDADH

SEQ ID NO: 60855 - protein, 2083 aa, Homo sapiens; identical to SEQ ID NO: 60850

SEQ ID NO: 60856 - protein, 722 aa, Homo sapiens
QILIATITHLLPSTEASSYEMDKRLVVSLLLCLLDWIMALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDAVGSYPEILPSETPTATQVDGADLASPMSPRTSKSRMSMKLRRSSGSANKS

SEQ ID NO: 60857 - protein, 902 aa, Homo sapiens
MVQRMWAEAAGPAGGAEPLFPGSRRSRSVWDAVRLEVGVPDSCPVVLHSFTQLDPDLPRPESSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 60858 - protein, 914 aa, Homo sapiens
MVQRMWAEAAGPAGGAEPLFPGSRRSRSVWDAVRLEVGVPDSCPVVLHSFTQLDPDLPRPESSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 60859 - protein, 446 aa, Homo sapiens
MPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPET

SEQ ID NO: 60860 - protein, 885 aa, Homo sapiens
MCLWGHSTAPAHTLSSPPLLFCSLPCALHLQPGTGHPPGQVPRKSSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 60861 - protein, 913 aa, Homo sapiens
MAREAGQVCARPAVPRGRKGSVFFACVSVVTARRRAVARRAALQSPTPWLAPLPAPATTESSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 60862 - protein, 859 aa, Homo sapiens
MMVDCQSSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 60863 - protein, 309 aa, Homo sapiens [sequence omitted]

SEQ ID NO: 60864 - protein, 985 aa, Homo sapiens
MHRRRLALGLGFCLLAGTSLSVLWVYLENWLPVSYVPYYLPCPEILPMMMALSCLCHQQHEAALQEGEATPARGMVTVPSAQAAGAQAHTAADTHTLVGAHRLRGNLQPRASAAHLPATEPDHWGHGVCRGESSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 60865 - protein, 803 aa, Homo sapiens
MEVKPVGEPTQEVSKFKLSTKVESTGHWLVEDHVRIWEVLKTEESSIQDWGEEVEEGAVYHVTLKRVQIQQAANKGARWLGVEGDQLPPGHTVSQYETCKIRTIKAGTLEKLVENLLTAFGDNDFTYISIFLSTYRGFASTKEVLELLLDRYGNLTSPNCEEDGSQSSSESKMVIRNAIASILRAWLDQCAEDFREPPHFPCLQKLLDYLTRMMPGSDPERRAQNLLEQFQKQEVETDNGLPNTISFSLEEEEELEGGESAEFTCFSEDLVAEQLTYMDAQLFKKVVPHHCLGCIWSRRDKKENKHLAPTIRATISQFNTLTKCVVSTILGGKELKTQQRAKIIEKWINIAHECRLLKNFSSLRAIVSALQSNSIYRLKKTWAAVPRDRMLMFEELSDIFSDHNNHLTSRELLMKEGTSKFANLDSSVKENQKRTQRRLQLQKDMGVMQGTVPYLGTFLTDLTMLDTALQDYIEGGLINFEKRRREFEVIAQIKLLQSACNSYCMTPDQKFIQWFQRQQLLTEEESYALSCEIEAAADASTTSPKPRKSMVKRLSLLFLGSDMITSPTPTKEQPKSTASGSSGESMDSVSVSSCESNHSEAEEGSITPMDTPDEPQKKLSESSSSCSSIHSMDTNSSGMSSLINPLSSPPSCNNNPKIHKRSVSVTSITSTVLPPVYNQQNEDTCIIRISVEDNNGNMYKSIMLTSQDKTPAVIQRAMLKHNLDSDPAEEYELVQVISEDKELVIPDSANVFYAMNSQVNFDFILRKKNSMEEQVKLRSRTSLTLPRTAKRGCWSNRHSKITL

SEQ ID NO: 60866 - protein, 768 aa, Homo sapiens
MKLLWQAKMSSIQDWGEEVEEGAVYHVTLKRVQIQQAANKGARWLGVEGDQLPPGHTVSQYETCKIRTIKAGTLEKLVENLLTAFGDNDFTYISIFLSTYRGFASTKEVLELLLDRYGNLTSPNCEEDGSQSSSESKMVIRNAIASILRAWLDQCAEDFREPPHFPCLQKLLDYLTRMMPGSDPERRAQNLLEQFQKQEVETDNGLPNTISFSLEEEEELEGGESAEFTCFSEDLVAEQLTYMDAQLFKKVVPHHCLGCIWSRRDKKENKHLAPTIRATISQFNTLTKCVVSTILGGKELKTQQRAKIIEKWINIAHECRLLKNFSSLRAIVSALQSNSIYRLKKTWAAVPRDRMLMFEELSDIFSDHNNHLTSRELLMKEGTSKFANLDSSVKENQKRTQRRLQLQKDMGVMQGTVPYLGTFLTDLTMLDTALQDYIEGGLINFEKRRREFEVIAQIKLLQSACNSYCMTPDQKFIQWFQRQQLLTEEESYALSCEIEAAADASTTSPKPRKSMVKRLSLLFLGSDMITSPTPTKEQPKSTASGSSGESMDSVSVSSCESNHSEAEEGSITPMDTPDEPQKKLSESSSSCSSIHSMDTNSSGMSSLINPLSSPPSCNNNPKIHKRSVSVTSITSTVLPPVYNQQNEDTCIIRISVEDNNGNMYKSIMLTSQDKTPAVIQRAMLKHNLDSDPAEEYELVQVISEDKELVIPDSANVFYAMNSQVNFDFILRKKNSMEEQVKLRSRTSLTLPRTAKRGCWSNRHSKITL

SEQ ID NO: 60867 - protein, 803 aa, Homo sapiens; identical to SEQ ID NO: 60865

SEQ ID NO: 60868 - protein, 766 aa, Homo sapiens
MEVKPVGEPTQEVSKFKLSTKVESTGHWLVEDHVRIWEVLKTEEVEGDQLPPGHTVSQYETCKIRTIKAGTLEKLVENLLTAFGDNDFTYISIFLSTYRGFASTKEVLELLLDRYGNLTSPNCEEDGSQSSSESKMVIRNAIASILRAWLDQCAEDFREPPHFPCLQKLLDYLTRMMPGSDPERRAQNLLEQFQKQEVETDNGLPNTISFSLEEEEELEGGESAEFTCFSEDLVAEQLTYMDAQLFKKVVPHHCLGCIWSRRDKKENKHLAPTIRATISQFNTLTKCVVSTILGGKELKTQQRAKIIEKWINIAHECRLLKNFSSLRAIVSALQSNSIYRLKKTWAAVPRDRMLMFEELSDIFSDHNNHLTSRELLMKEGTSKFANLDSSVKENQKRTQRRLQLQKDMGVMQGTVPYLGTFLTDLTMLDTALQDYIEGGLINFEKRRREFEVIAQIKLLQSACNSYCMTPDQKFIQWFQRQQLLTEEESYALSCEIEAAADASTTSPKPRKSMVKRLSLLFLGSDMITSPTPTKEQPKSTASGSSGESMDSVSVSSCESNHSEAEEGSITPMDTPDEPQKKLSESSSSCSSIHSMDTNSSGMSSLINPLSSPPSCNNNPKIHKRSVSVTSITSTVLPPVYNQQNEDTCIIRISVEDNNGNMYKSIMLTSQDKTPAVIQRAMLKHNLDSDPAEEYELVQVISEDKELVIPDSANVFYAMNSQVNFDFILRKKNSMEEQVKLRSRTSLTLPRTAKRGCWSNRHSKITL

SEQ ID NO: 60869 - protein, 739 aa, Homo sapiens
MKLLWQAKMSSIQDWGEEVEEGAVYHVTLKRVQIQQAANKGARWLGVEGDQLPPGHTVSQYETCKIRTIKAGTLEKLVENLLTAFGDNDFTYISIFLSTYRGFASTKEVLELLLDRYGNLTSPNCEEDGSQSSSESKMVIRNAIASILRAWLDQCAEDFREPPHFPCLQKLLDYLTRMMPGSDPERRAQNLLEQFQKQEVETDNGLPNTISFSLEEEEELEGGESAEFTCFSEDLVAEQLTYMDAQLFKKVVPHHCLGCIWSRRDKKENKHLAPTIRATISQFNTLTKCVVSTILGGKELKTQQRAKIIEKWINIAHECRLLKNFSSLRAIVSALQSNSIYRLKKTWAAVPRDRMLMFEELSDIFSDHNNHLTSRELLMKEGTSKFANLDSSVKENQKRTQRRLQLQKDMGGLINFEKRRREFEVIAQIKLLQSACNSYCMTPDQKFIQWFQRQQLLTEEESYALSCEIEAAADASTTSPKPRKSMVKRLSLLFLGSDMITSPTPTKEQPKSTASGSSGESMDSVSVSSCESNHSEAEEGSITPMDTPDEPQKKLSESSSSCSSIHSMDTNSSGMSSLINPLSSPPSCNNNPKIHKRSVSVTSITSTVLPPVYNQQNEDTCIIRISVEDNNGNMYKSIMLTSQDKTPAVIQRAMLKHNLDSDPAEEYELVQVISEDKELVIPDSANVFYAMNSQVNFDFILRKKNSMEEQVKLRSRTSLTLPRTAKRGCWSNRHSKITL

SEQ ID NO: 60870 - protein, 390 aa, Homo sapiens
MGSFKDRGDGLPNTISFSLEEEEELEGGESAEFTCFSEDLVAEQLTYMDAQLFKKVVPHHCLGCIWSRRDKKENKHLAPTIRATISQFNTLTKCVVSTILGGKELKTQQRAKIIEKWINIAHECRLLKNFSSLRAIVSALQSNSIYRLKKTWAAVPRDRMLMFEELSDIFSDHNNHLTSRELLMKEGTSKFANLDSSVKENQKRTQRRLQLQKDMGVMQGTVPYLGTFLTDLTMLDTALQDYIEGGLINFEKRRREFEVIAQIKLLQSACNSYCMTPDQKFIQWFQRQQLLTEEESYALSCEIEAAADASTTSPKPRKSMVKRLSLLFLGSDMITSPTPTKEQPKSTASGSSGESMDSVSVSSCESNHSEAEEGSITPMDTPDEPQKKAL

SEQ ID NO: 60871 - protein, 473 aa, Homo sapiens
MRKLLTNLPAAAVLSAQVYSAVLQGLWEENVCGTPGRTRVCTALLYGQVCPFQDSTDGLRTITSILFNWPPENTSVYYQPPQRSSFRIKLAFRNLSWPGLGLEDHQEIVLGQLVLPEPNEAKPDDPAPRPGQHALTMPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKESYKLSCQLEPENP

SEQ ID NO: 60872 - protein, 580 aa, Homo sapiens
MRKLLTNLPAAAVLSAQVYSAVLQGLWEENVCGTPGRTRVCTALLYGQVCPFQDSTDGLRTITSILFNWPPENTSVYYQPPQRSSFRIKLAFRNLSWPGLGLEDHQEIVLGQLVLPEPNEAKPDDPAPRPGQHALTMPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKERWGFTMMSRIVSNSWPQAIHPPQPPKVLTLQLQAVLPAGARKPVGWQHPAVAGNPPGCWPEHRLCTIPHPDRRHQGTTSRRLAAQLHLALDPHHQLLLLARIRPWDFCESGGRPFYVYFL

SEQ ID NO: 60873 - protein, 655 aa, Homo sapiens
MTECFLPPTSSPSEHRRVEHGSGLTRTPSSEEISPTKFPGLYRTGEPSPPHDILHEPPDVVSDDEKDHGKKKGKFKKKEKRTEGYAAFQEDSSGDEAESPSKMKRSKGIHVFKKPSFSKKKEKDFKIKEKPKEEKHKEEKHKEEKHKEKKSKDLTAADVVKQWKEKKKKKKPIQEPEVPQIDVPNLKPIFGIPLADAVERTMMYDGIRLPAVFRECIDYVEKYGMKCEGIYRVSGIKSKVDELKAAYDREESTNLEDYEPNTVASLLKQYLRDLPENLLTKELMPRFEEACGRTTETEKVQEFQRLLKELPECNYLLISWLIVHMDHVIAKELETKMNIQNISIVLSPTVQISNRVLYVFFTHVQELFGNVVLKQVMKPLRWSNMATMPTLPETQAGIKEEIRRQEFLLNCLHRDLQGGIKDLSKEERLWEVQRILTALKRKLREAKRQECETKIAQEIASLSKEDVSKEEMNENEEVINILLAQENEILTEQEELLAMEQFLRRQIASEKEEIERLRAEIAEIQSRQQHGRSETEEYSSESESESEDEEELQIILEDLQRQNEELEIKNNHLNQAIHEEREAIIELRVQLRLLQMQRAKAEQQAQEDEEPEWRGGAVQPPRDGVLEPKAAKEQPKAGKEPAKPSPSRDRKETSI

SEQ ID NO: 60874 - protein, 655 aa, Homo sapiens; identical to SEQ ID NO: 60873

SEQ ID NO: 60875 - protein, 347 aa, Homo sapiens
MTECFLPPTSSPSEHRRVEHGSGLTRTPSSEEISPTKFPGLYRTGEPSPPHDILHEPPDVVSDDEKDHGKKKGKFKKKEKRTEGYAAFQEDSSGDEAESPSKMKRSKGIHVFKKPSFSKKKEKDFKIKEKPKEEKHKEEKHKEEKHKEKKSKDLTAADVVKQWKEKKKKKKPIQEPEVPQIDVPNLKPIFGIPLADAVERTMMYDGIRLPAVFRECIDYVEKYGMKCEGIYRVSGIKSKVDELKAAYDREESTNLEDYEPNTVASLLKQYLRDLPENLLTKELMPRFEEACGRTTETEKVQSSGEEAARSCQFLTAGTSKGLLTGLVKGSHLGLVHPQRMLFKPEIF

SEQ ID NO: 60876 - protein, 659 aa, Homo sapiens
MEAAAAAAAAAAAAAAAGGGCGSGPPPLLLSEGEQQCYSELFARCAGAAGGGPGSGPPEAARVAPGTATAAAGPVADLFRASQLPAETLHQITELCGAKRVGYFGPTQFYIALKLIAAAQSGLPVRIESIKCELPLPRFMMSKNDGEIRFGNPAELHGTKVQIPYLTTEKNSFKRMDDEDKQETQSPTMSPLASPPSSPPHYQRVPLSHGYSKLRSSAEQMHPAPYEARQPLVQPEGSSSGGPGTKPLRHQASLIRSFSVERELQDNSSYPDEPWRITEEQREYYVNQFRSLQPDPSSFISGSVAKNFFTKSKLSIPELSYIWELSDADCDGALTLPEFCAAFHLIVARKNGYPLPEGLPPTLQPEYLQAAFPKPKWDCQLFDSYSESLPANQQPRDLNRMEKTSVKDMADLPVPNQDVTSDDKQALKSTINEALPKDVSEDPATPKDSNSLKARPRSRSYSSTSIEEAMKRGEDPPTPPPRPQKTHSRASSLDLNKVFQPSVPATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKEVHQERIALENQLEQLRPVTVL

SEQ ID NO: 60877 - protein, 660 aa, Homo sapiens
MEAAAAAAAAAAAAAAAGGGCGSGPPPLLLSEGEQQCYSELFARCAGAAGGGPGSGPPEAARVAPGTATAAAGPVADLFRASQLPAETLHQITELCGAKRVGYFGPTQFYIALKLIAAAQSGLPVRIESIKCELPLPRFMMSKNDGEIRFGNPAELHGTKVQIPYLTTEKNSFKRMDDEDKQQETQSPTMSPLASPPSSPPHYQRVPLSHGYSKLRSSAEQMHPAPYEARQPLVQPEGSSSGGPGTKPLRHQASLIRSFSVERELQDNSSYPDEPWRITEEQREYYVNQFRSLQPDPSSFISGSVAKNFFTKSKLSIPELSYIWELSDADCDGALTLPEFCAAFHLIVARKNGYPLPEGLPPTLQPEYLQAAFPKPKWDCQLFDSYSESLPANQQPRDLNRMEKTSVKDMADLPVPNQDVTSDDKQALKSTINEALPKDVSEDPATPKDSNSLKARPRSRSYSSTSIEEAMKRGEDPPTPPPRPQKTHSRASSLDLNKVFQPSVPATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKEVHQERIALENQLEQLRPVTVL

SEQ ID NO: 60878 - protein, 607 aa, Homo sapiens
MEAAAAAAAAAAAAAAAGGGCGSGPPPLLLSEGEQQCYSELFARCAGAAGGGPGSGPPEAARVAPGTATAAAGPVADLFRASQLPAETLHQITELCGAKRVGYFGPTQFYIALKLIAAAQSGLPVRIESIKCELPLPRFMMSKNDGEIRFGNPAELHGTKVQIPYLTTEKNSFKRMDDEDKQQETQSPTMSPLASPPSSPPHYQRVPLSHGYSKLRSSAEQMHPAPYEARQPLVQPEGSSSGGPGTKPLRHQASLIRSFSVERELQDNSSYPDEPWRITEEQREYYVNQFRSLQPDPSSFISGSVAKNFFTKSKLSIPELSYIWELSDADCDGALTLPEFCAAFHLIVARKNGYPLPEGLPPTLQPEYLQAAFPKPKWDCQLFDSYSESLPANQQPRDLNRMEKTSVKDMADLPVPNQDVTSDDKQALKSTINEALPKDVSEDPATPKDSNSLKARPRSRSYSSTSIEEAMKRGEDPPTPPPRPQKTHSRASSLDLNKVFQPSVPATKSGLLPPPPALPPRPCPSQSEQVSEAELLPQLSRAPSQAAESSPAKKDVLYSQPPSKPIRRKFRPVCGIQPLISIELRAFRTSRHLFNVSLVHWQALSIA

SEQ ID NO: 60879 - protein, 459 aa, Homo sapiens
MMSKNDGEIRFGNPAELHGTKVQIPYLTTEKNSFKRMDDEDKQETQSPTMSPLASPPSSPPHYQRVPLSHGYSKLRSSAEQMHPAPYEARQPLVQPEGSSSGGPGTKPLRHQASLIRSFSVERELQDNSSYPDEPWRITEEQREYYVNQFRSLQPDPSSFISGSVAKNFFTKSKLSIPELSYIWELSDADCDGALTLPEFCAAFHLIVARKNGYPLPEGLPPTLQPEYLQAAFPKPKWDCQLFDSYSESLPANQQPRDLNRMEKTSVKDMADLPVPNQDVTSDDKQALKSTINEALPKDVSEDPATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKEVHQERIALENQLEQLRPVTVL

SEQ ID NO: 60880 - protein, 620 aa, Homo sapiens
MAAATADPGAGNPQPGDSSGGGAGGGLPSPGEQELSRRLQRLYPAVNQQETPLPRSWSPKDKYNYIGLSQGNLRVHYKGHGKNHKDAASVRATHPIPAACGIYYFEVKIVSKGRDGYMGIGLSAQGVNMNRLPGWDKHSYGYHGDDGHSFCSSGTGQPYGPTFTTGDVIGCCVNLINGTCFYTKNGHSLGIAFTDLPANLYPTVGLQTPGEIVDANFGQQPFLFDIEDYMREWRAKVQGTVHCFPISARLGEWQAVLQNMVSSYLVHHGYCATATAFARMTETPIQEEQASIKNRQKIQKLVLEGRVGEAIETTQRFYPGLLEHNPNLLFMLKCRQFVEMVNGTDSEVRSLSSRSPKSQDSYPGSPSLSPRHGPSSSHMHNTGADSPSCSNGVASTKSKQNHSKYPAPSSSSSSSSSSSSSSPSSVNYSESNSTDSTKSQHHSSTSNQETSDSEMEMEAEHYPNGVLGSMSTRIVNGAYKHEDLQTDESSMDDRHPRRQLCGGNQAATERIILFGRELQALSEQLGREYGKNLAHTEMLQDAFSLLAYSDPWSCPVGQQLDPIQREPVCAALNSAILESQNLPKQPPLMLALGQASECLRLMARAGLGSCSFARVDDYLH

SEQ ID NO: 60881 - protein, 533 aa, Homo sapiens
MGIGLSAQGVNMNRLPGWDKHSYGYHGDDGHSFCSSGTGQPYGPTFTTGDVIGCCVNLINGTCFYTKNGHSLGIAFTDLPANLYPTVGLQTPGEIVDANFGQQPFLFDIEDYMREWRAKVQGTVHCFPISARLGEWQAVLQNMVSSYLVHHGYCATATAFARMTETPIQEEQASIKNRQKIQKLVLEGRVGEAIETTQRFYPGLLEHNPNLLFMLKCRQFVEMVNGTDSEVRSLSSRSPKSQDSYPGSPSLSPRHGPSSSHMHNTGADSPSCSNGVASTKSKQNHSKYPAPSSSSSSSSSSSSSSPSSVNYSESNSTDSTKSQHHSSTSNQETSNPWLQLERRPNQAAPTTPPGPTPTSTPPHSDSEMEMEAEHYPNGVLGSMSTRIVNGAYKHEDLQTDESSMDDRHPRRQLCGGNQAATERIILFGRELQALSEQLGREYGKNLAHTEMLQDAFSLLAYSDPWSCPVGQQLDPIQREPVCAALNSAILESQNLPKQPPLMLALGQASECLRLMARAGLGSCSFARVDDYLH

SEQ ID NO: 60882 - protein, 179 aa, Homo sapiens
MGWDKHSYGYHGDDGHSFCSSGTGQPYGPTFTTGDVIGCCVNLINGTCFYTKNGHSLGIAFTDLPANLYPTVGLQTPGEIVDANFGQQPFLFDIEDYMREWRAKVQGTVHCFPISARLGEWQAVLQNMVSSYLVHHGYCATATAFARMTETPIQEEQASIKNRQSKVYSTFPFPFLTCP

SEQ ID NO: 60883 - protein, 594 aa, Homo sapiens
MAAATADPGAGNPQPGDSSGGGAGGGLPSPGEQELSRRLQRLYPAVNQQETPLPRSWSPKDKYNYIGLSQGNLRVHYKGHGKNHKDAASVRATHPIPAACGIYYFEVKIVSKGRDGYMGIGLSAQGVNMNRLPGIAFTDLPANLYPTVGLQTPGEIVDANFGQQPFLFDIEDYMREWRAKVQGTVHCFPISARLGEWQAVLQNMVSSYLVHHGYCATATAFARMTETPIQEEQASIKNRQKIQKLVLEGRVGEAIETTQRFYPGLLEHNPNLLFMLKCRQFVEMVNGTDSEVRSLSSRSPKSQDSYPGSPSLSPRHGPSSSHMHNTGADSPSCSNGVASTKSKQNHSKYPAPSSSSSSSSSSSSSSPSSVNYSESNSTDSTKSQHHSSTSNQETSNPWLQLERRPNQAAPTTPPGPTPTSTPPHSDSEMEMEAEHYPNGVLGSMSTRIVNGAYKHEDLQTDESSMDDRHPRRQLCGGNQAATERIILFGRELQALSEQLGREYGKNLAHTEMLQDAFSLLAYSDPWSCPVGQQLDPIQREPVCAALNSAILESQNLPKQPPLMLALGQASECLRLMARAGLGSCSFARVDDYLH

SEQ ID NO: 60884 - protein, 391 aa, Homo sapiens
MREWRAKVQGTVHCFPISARLGEWQAVLQNMVSSYLVHHGYCATATAFARMTETPIQEEQASIKNRQKIQKLVLEGRVGEAIETTQRFYPGLLEHNPNLLFMLKCRQFVEMVNGTDSEVRSLSSRSPKSQDSYPGSPSLSPRHGPSSSHMHNTGADSPSCSNGVASTKSKQNHSKYPAPSSSSSSSSSSSSSSPSSVNYSESNSTDSTKSQHHSSTSNQETSDSEMEMEAEHYPNGVLGSMSTRIVNGAYKHEDLQTDESSMDDRHPRRQLCGGNQAATERIILFGRELQALSEQLGREYGKNLAHTEMLQDAFSLLAYSDPWSCPVGQQLDPIQREPVCAALNSAILESQNLPKQPPLMLALGQASECLRLMARAGLGSCSFARVDDYLH

SEQ ID NO: 60885 - protein, 1088 aa, Homo sapiens
MALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVFAKPLNLQDQCQQNLVMQVLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQGLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEGRLAWLVYLVGTVVGGRLTYTSTDEHDAMDGELSCRVFQLISLMDTGLPRCCNEKIELAILWFLDQFRKTYVGDQLQRTSKVYARMSEVLGITDDNHVLETFMTKIVTNLKYWGRYEPVISRTLQFLNDLSVGYILLKKLVKIDAVKFMLKNHTSEHFPFLGISDNHSLSDFRCRTTFYTALTRLLMVDLGEDEDEFENFMLPLTVAFETVLQIFNNNFKQEDVKRMLIGLARDLRGIAFALNTKTSYTMLFDWMYPTYLPLLQNAVERWYGEPTCTTPILKLMAELMQNRSQRLNFDVSSPNGILLFREASKMVCTYGNQILSLGSLSKDQIYPMKLKGISICYSALKSALCGNYVSFGVFKLYGDNHFDNVLQAFVKMLLSVSHSDLLQYRKLSQSYYPLLECLTQDHMSFIINLEPPVLMYVLTSISEGLTTLDTVVSSSCCTSLDYIVTYLFKHIAKEGKKPLRCREATQAGQRLLHFMQQNPDVLQQMMSVLMNTIVFEDCRNQWSVSRPLLGLILLNEKYFSELRASLINSQPLPKQEVLAQCFRNLMEGVEQNLSVKNRDRFTQNLSVFRRDVAEALRSDGNTEPCSLDMMS

SEQ ID NO: 60886 - protein, 518 aa, Homo sapiens
VYARMSEVLGITDDNHVLETFMTKIVTNLKYWGRYEPVISRTLQFLNDLSVGYILLKKLVKIDAVKFMLKNHTSEHFPFLGISDNHSLSDFRCRTTFYTALTRLLMVDLGEDEDEFENFMLPLTVAFETVLQIFNNNFKQEDVKRMLIGLARDLRGIAFALNTKTSYTMLFDWMYPTYLPLLQNAVERWYGEPTCTTPILKLMAELMQNRSQRLNFDVSSPNGILLFREASKMVCTYGNQILSLGSLSKDQIYPMKLKGISICYSALKSALCGNYVSFGVFKLYGDNHFDNVLQAFVKMLLSVSHSDLLQYRKLSQSYYPLLECLTQDHMSFIINLEPPVLMYVLTSISEGLTTLDTVVSSSCCTSLDYIVTYLFKHIAKEGKKPLRCREATQAGQRLLHFMQQNPDVLQQMMSVLMNTIVFEDCRNQWSVSRPLLGLILLNEKYFSELRASLINSQPLPKQEVLAQCFRNLMEGVEQNLSVKNRDRFTQNLSVFRRDVAEALRSDGNTEPCSLDMMS

SEQ ID NO: 60887 - protein, 472 aa, Homo sapiens
MDIRNYILNYVASQPKLAPFVIQALIQVIAKITKLGWFEVQKDQFVFREIIADVKKFLQVDYSRPSAKHRKIATSFRDTSLKDVLVLACSLLKEVFAKPLNLQDQCQQNLVMQVLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQGLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEGRLAWLVYLVGTVVGGRLTYTSTDEHDAMDGELSCRVFQLISLMDTGLPRCCNEKIELAILWFLDQFRKTYVGDQLQRTSKKTFIYL

SEQ ID NO: 60888 - protein, 3224 aa, Homo sapiens
MRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKDKNFQWANTGAAVFGTQSVGTQSAGKVGEDEDGSDEEVVHNEDIHFEPIVSLPEVEVKSGEEDEEILFKERAKLYRWDRDVSQWKERGVGDIKILWHTMKNYYRILMRRDQVFKVCANHVITKTMELKPLNVSNNALVWTASDYADGEAKVEQLAVRFKTKEVADCFKKTFEECQQNLMKLQKGHVSLAAELSKETNPVVFFDVCADGEPLGRITMELFSNIVPRTAENFRALCTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 60889 - protein, 499 aa, Homo sapiens
MADLANEEKPAIAPPVFVFQKDKGQKRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 60890 - protein, 397 aa, Homo sapiens
ADVTKAEKPAIAPPVFVFQKDKGQKRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWWLLRHPHPSHPAVGPCLCGEQPALCPCPGLPNYRPGTPAQLGGLLVRV

SEQ ID NO: 60891 - protein, 567 aa, Homo sapiens
MADLANEEKPAIAPPVFVFQKDKGQKSPAEQKNLSDSGEEPRGEAEAPHHGTGHPESAGEHALEPPAPAGASASTPPPPAPEAQLPPFPRELAGRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 60892 - protein, 562 aa, Homo sapiens
MADLANEEKPAIAPPVFVFQKDKGQKSPAEQKNLSDSGEEPRGEAEAPHHGTGHPESAGEHALEPPAPAGASASTPPPPAPEAQLPPFPRELAGRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 60893 - protein, 439 aa, Homo sapiens
MADLANEEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 60894 - protein, 729 aa, Homo sapiens
MSGQPPPPPPQQQQQQQQLSPPPPAALAPVSGVVLPAPPAVSAGSSPAGSPGGGAGGEGLGAAAAALLLHPPPPPPPATAAPPPPPPPPPPPASAAAPASGPPAPPGLAAGPGPAGGAPTPALVAGSSAAAPFPHGDSALNEQEKELQRRLKRLYPAVDEQETPLPRSWSPKDKFSYIGLSQNNLRVHYKGHGKTPKDAASVRATHPIPAACGIYYFEVKIVSKGRDGYMGIGLSAQGVNMNRLPGWDKHSYGYHGDDGHSFCSSGTGQPYGPTFTTGDVIGCCVNLINNTCFYTKNGHSLGIAFTDLPPNLYPTVGLQTPGEVVDANFGQHPFVFDIEDYMREWRTKIQAQIDRFPIGDREGEWQTMIQKMVSSYLVHHGYCATAEAFARSTDQTVLEELASIKNRQRIQKLVLAGRMGEAIETTQQLYPSLLERNPNLLFTLKVRQFIEMVNGTDSEVRCLGGRSPKSQDSYPVSPRPFSSPSMSPSHGMNIHNLASGKGSTAHFSGFESCSNGVISNKAHQSYCHSNKHQSSNLNVPELNSINMSRSQQVNNFTSNDVDMETDHYSNGVGETSSNGFLNGSSKHDHEMEDCDTEMEVDSSQLRRQLCGGSQAAIERMIHFGRELQAMSEQLRRDCGKNTANKKMLKDAFSLLAYSDPWNSPVGNQLDPIQREPVCSALNSAILETHNLPKQPPLALAMGQATQCLGLMARSGIGSCAFATVEDYLH

SEQ ID NO: 60895 - protein, 391 aa, Homo sapiens
MSGQPPPPPPQQQQQQQQLSPPPPAALAPVSGVVLPAPPAVSAGSSPAGSPGGGAGGEGLGAAAAALLLHPPPPPPPATAAPPPPPPPPPPPASAAAPASGPPAPPGLAAGPGPAGGAPTPALVAGSSAAAPFPHGDSALNEQEKELQRRLKRLYPAVDEQETPLPRSWSPKDKFSYIGLSQNNLRVHYKGHGKTPKDAASVRATHPIPAACGIYYFEVKIVSKGRDGYMGIGLSAQGVNMNRLPGWDKHSYGYHGDDGHSFCSSGTGQPYGPTFTTGDVIGCCVNLINNTCFYTKNGHSLGIAFTDLPPLDYPVSPRPFSSPSMSPSHGMNIHNLASGKGSTAHFSGFESCSNGVISNKAHQSYCHSNKHQSSNECTRTKQYKYVKITAS

SEQ ID NO: 60896 - protein, 500 aa, Homo sapiens
MGIGLSAQGVNMNRLPGWDKHSYGYHGDDGHSFCSSGTGQPYGPTFTTGDVIGCCVNLINNTCFYTKNGHSLGIAFTDLPPNLYPTVGLQTPGEVVDANFGQHPFVFDIEDYMREWRTKIQAQIDRFPIGDREGEWQTMIQKMVSSYLVHHGYCATAEAFARSTDQTVLEELASIKNRQRIQKLVLAGRMGEAIETTQQLYPSLLERNPNLLFTLKVRQFIEMVNGTDSEVRCLGGRSPKSQDSYPVSPRPFSSPSMSPSHGMNIHNLASGKGSTAHFSGFESCSNGVISNKAHQSYCHSNKHQSSNLNVPELNSINMSRSQQVNNFTSNDVDMETDHYSNGVGETSSNGFLNGSSKHDHEMEDCDTEMEVDSSQLRRQLCGGSQAAIERMIHFGRELQAMSEQLRRDCGKNTANKKMLKDAFSLLAYSDPWNSPVGNQLDPIQREPVCSALNSAILETHNLPKQPPLALAMGQATQCLGLMARSGIGSCAFATVEDYLH

SEQ ID NO: 60897 - protein, 128 aa, Homo sapiens
MFDVTSRVTYKNVPNWHRDLVRVCENIPIVLCGNKVDIKDRKVKAKSIVFHRKKNLQYYDISAKSNYNFEKPFLWLARKLIGDPNLEFVAMPALAPPEVVMDPALAAQYEHDLEVAQTTALPDEDDDL

SEQ ID NO: 60898 - protein, 233 aa, Homo sapiens
MAAQGEPQVQFKLVLVGDGGTGKTTFVKRHLTGEFEKKYVATLGVEVHPLVFHTNRGPIKFNVWDTAGQEKFGGLRDGYYIQEMGIHHVAHAGLELMSSAQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALAPPEVVMDPALAAQYEHDLEVAQTTALPDEDDDL

SEQ ID NO: 60899 - protein, 216 aa, Homo sapiens
MAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALAPPEVVMDPALAAQYEHDLEVAQTTALPDEDDDL

SEQ ID NO: 60900 - protein, 234 aa, Homo sapiens
RRRRLRLRRLNCASAIFPASVGRARRRFWKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALAPPEVVMDPALAAQYEHDLEVAQTTALPDEDDDL

SEQ ID NO: 60901 - protein, 128 aa, Homo sapiens; identical to SEQ ID NO: 60897

SEQ ID NO: 60902 - protein, 216 aa, Homo sapiens; identical to SEQ ID NO: 60899

SEQ ID NO: 60903 - protein, 1756 aa, Homo sapiens
MRRSKAYGERYLASVQGSAPSPGKKLRGFYFAKLYYEAKEYDLAKKYVCTYLSVQERDPRAHRFLGLLYELEENTEKAVECYRRSLELNPPQKDLVLKIAELLCKNDVTDGRAKYWVERAAKLFPGSPAIYKLKEHLLDCEGEDGWNKLFDWIQSELYVRPDDVHMNIRLVELYRSNKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWQALSELAALCYVIAFQVPRPKIKLIKGEAGQNLLEMMACDRLSQSGHMLLNLSRGKQDFLKEVVETFANKSGQSVLYNALFSSQSSKDTSFLGSDDIGNIDVQEPELEDLARYDVGAIQAHNGSLQHLTWLGLQWNSLPALPGIRKWLKQLFHHLPQETSRLETNAPESICILDLEVFLLGVVYTSHLQLKEKCNSHHSSYQPLCLPLPVCKRLCTERQKSWWDAVCTLIHRKAVPGNSAELRLVVQHEINTLRAQEKHGLQPALLVHWAKCLQKMGRGLNSSYDQQEYIGRSVHYWKKVLPLLKIIKKNSIPEPIDPLFKHFHSVDIQASEIVEYEEDAHITFAILDAVHGNIEDAVTAFESIKSVVSYWNLALIFHRKAEDIENDAVFPEEQEECKNYLRKTRDYLIKIIDDSDSNLSVVKKLPVPLESVKEMLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHRAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 60904 - protein, 1748 aa, Homo sapiens
MNVMGFNTDRLAWTRNKLRGFYFAKLYYEAKEYDLAKKYVCTYLSVQERDPRAHRFLGLLYELEENTEKAVECYRRSLELNPPQKDLVLKIAELLCKNDVTDGRAKYWVERAAKLFPGSPAIYKLKEHLLDCEGEDGWNKLFDWIQSELYVRPDDVHMNIRLVELYRSNKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWQALSELAALCYVIAFQVPRPKIKLIKGEAGQNLLEMMACDRLSQSGHMLLNLSRGKQDFLKEVVETFANKSGQSVLYNALFSSQSSKDTSFLGSDDIGNIDVQEPELEDLARYDVGAIQAHNGSLQHLTWLGLQWNSLPALPGIRKWLKQLFHHLPQETSRLETNAPESICILDLEVFLLGVVYTSHLQLKEKCNSHHSSYQPLCLPLPVCKRLCTERQKSWWDAVCTLIHRKAVPGNSAELRLVVQHEINTLRAQEKHGLQPALLVHWAKCLQKMGRGLNSSYDQQEYIGRSVHYWKKVLPLLKIIKKNSIPEPIDPLFKHFHSVDIQASEIVEYEEDAHITFAILDAVHGNIEDAVTAFESIKSVVSYWNLALIFHRKAEDIENDAVFPEEQEECKNYLRKTRDYLIKIIDDSDSNLSVVKKLPVPLESVKEMLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHRAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 60905 - protein, 644 aa, Homo sapiens
MLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHRAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSEREPSSCYKYDVAAQP

SEQ ID NO: 60906 - protein, 1748 aa, Homo sapiens; identical to SEQ ID NO: 60904

SEQ ID NO: 60907 - protein, 1013 aa, Homo sapiens
MLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHMAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 60908 - protein, 1756 aa, Homo sapiens
MRRSKAYGERYLASVQGSAPSPGKKLRGFYFAKLYYEAKEYDLAKKYVCTYLSVQERDPRAHRFLGLLYELEENTEKAVECYRRSLELNPPQKDLVLKIAELLCKNDVTDGRAKYWVERAAKLFPGSPAIYKLKEHLLDCEGEDGWNKLFDWIQSELYVRPDDVHMNIRLVELYRSNKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWQALSELAALCYVIAFQVPRPKIKLIKGEAGQNLLEMMACDRLSQSGHMLLNLSRGKQDFLKEVVETFANKSGQSVLYNALFSSQSSKDTSFLGSDDIGNIDVQEPELEDLARYDVGAIQAHNGSLQHLTWLGLQWNSLPALPGIRKWLKQLFHHLPQETSRLETNAPESICILDLEVFLLGVVYTSHLQLKEKCNSHHSSYQPLCLPLPVCKRLCTERQKSWWDAVCTLIHRKAVPGNSAELRLVVQHEINTLRAQEKHGLQPALLVHWAKCLQKMGRGLNSSYDQQEYIGRSVHYWKKVLPLLKIIKKNSIPEPIDPLFKHFHSVDIQASEIVEYEEDAHITFAILDAVHGNIEDAVTAFESIKSVVSYWNLALIFHRKAEDIENDAVFPEEQEECKNYLRKTRDYLIKIIDDSDSNLSVVKKLPVPLESVKEMLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHMAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 60909 - protein, 1748 aa, Homo sapiens
MNVMGFNTDRLAWTRNKLRGFYFAKLYYEAKEYDLAKKYVCTYLSVQERDPRAHRFLGLLYELEENTEKAVECYRRSLELNPPQKDLVLKIAELLCKNDVTDGRAKYWVERAAKLFPGSPAIYKLKEHLLDCEGEDGWNKLFDWIQSELYVRPDDVHMNIRLVELYRSNKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWQALSELAALCYVIAFQVPRPKIKLIKGEAGQNLLEMMACDRLSQSGHMLLNLSRGKQDFLKEVVETFANKSGQSVLYNALFSSQSSKDTSFLGSDDIGNIDVQEPELEDLARYDVGAIQAHNGSLQHLTWLGLQWNSLPALPGIRKWLKQLFHHLPQETSRLETNAPESICILDLEVFLLGVVYTSHLQLKEKCNSHHSSYQPLCLPLPVCKRLCTERQKSWWDAVCTLIHRKAVPGNSAELRLVVQHEINTLRAQEKHGLQPALLVHWAKCLQKMGRGLNSSYDQQEYIGRSVHYWKKVLPLLKIIKKNSIPEPIDPLFKHFHSVDIQASEIVEYEEDAHITFAILDAVHGNIEDAVTAFESIKSVVSYWNLALIFHRKAEDIENDAVFPEEQEECKNYLRKTRDYLIKIIDDSDSNLSVVKKLPVPLESVKEMLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHMAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 60910 - protein, 644 aa, Homo sapiens
MLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHMAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSEREPSSCYKYDVAAQP

SEQ ID NO: 60911 - protein, 1766 aa, Homo sapiens
MSCSKAYGERYVASVQGSAPSPRKKSTRGFYFAKLYYEAKEYDLAKKYICTYINVREMDPRAHRFLGLLYELEENTEKAVECYRRSVELNPTQKDLVLKIAELLCKNDVTDGRAEYWVERAAKLFPGSPAIYKLKEQLLDCEGEDGWNKLFDLIQSELYVRPDDVHVNIRLVELYRSTKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWRALSELAALCYLIAFQVPRPKIKLIKGEAGQNLLEMMACDRLSQSGHMLLNLSRGKQDFLKVVVETFANKSGQSALYDALFSSQSPKDTSFLGSDDIGNIDVQEPELEDLARYDVGAIRAHNGSLQHLTWLGLQWNSLPALPGIRKWLKQLFHHLPQETSRLETNAPESICILDLEVFLLGVVYTSHLQLKEKCNSHHSSYQPLCLPLPVCKQLCTERQKSWWDAVCTLIHRKAVPGNSAKLRLLVQHEINTLRAQEKHGLQPALLVHWAKCLQKMGSGLNSFYDQREYIGRSVHYWKKVLPLLKIIKKKNSIPEPIDPLFKHFHSVDIQASEIVEYEEDAHVTFAILDAVNGNIEDAMTAFESIKSVVSYWNLALIFHRKAEDIANDALSPEEQEECKNYLRKTRGYLIKILDDSDSNLSVVKKLPVPLESVKEMLKSVMQELENYSEGGPLYKNGSLRNADSEIKHSTPSPTKYSLSPSKSYKYSPKTPPRWAEDQNSLLKMIRQEVKAIKEEMQELKLNSSKSASHHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKSEKPLENDTGLQAQDISGRKKGRGVIFGQTSSTFTFADVAKSTSGEGFQFGKKDLNFKGFSGAGEKLFSSQYGKMANKANTSGDFEKDDDAYKTEDSDDIHFEPVVQMPEKVELVTGEEGEKVLYSQGVKLFRFDAEVSQWKERGLGNLKILKNEVNGKVRMLMQREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVAEEENKGSGTGAAGASDTTIKPNAENTGPTLEWDNYDLREDALDDSVSSSSVHASPLASSPVRKNLFHFDESTTGSNFSFKSALSLSKSPAKLNQSGTSVGTDEESDVTQEEERDGQYFEPVVPLPDLVEVSSGEENEQVVFSHRAEFYRYDKDVGQWKERGIGDIKILQNYDNKHVRILMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWYAEFTKEELVQKLSSTTKSADHLNGLLREIEATNAVLMEQIKLLKSEIRRLERNQEQEVSAANVEHLKNVLLQFIFLKPGSERERLLPVINTMLQLSLEEKGKLAAVAQAERGFVLNSTF

SEQ ID NO: 60912 - protein, 156 aa, Homo sapiens
MDPRAHRFLGLLYELEENTEKAVECYRRSVELNPTQKDLVLKIAELLCKNDVTDGRAEYWVERAAKLFPGSPAIYKLKEQLLDCEGEDGWNKLFDLIQSELYVRPDDVHVNIRLVELYRSTKRLKDAVARCHEAERNIALRSSLEWNSCVVQTLKF

SEQ ID NO: 60913 - protein, 1125 aa, Homo sapiens
MLLTLSTRDVQESRELLESFDSALQSAKSSLGGNDELSATFLEMKGHFYMHAGSLLLKMGQHGNNVQWRALSELAALCYLIAFQVPRPKIKLIKGEAGQNLLEMMACDRLSQSGHMLLNLSRGKQDFLKVVVETFANKSGQSALYDALFSSQSPKDTSFLGSDDIGNIDVQEPELEDLARYDVGAIRAHNGSLQHLTWLGLQWNSLPALPGIRKWLKQLFHHLPQETSRLETNAPESICILDLEVFLLGVVYTSHLQLKEKCNSHHSSYQPLCLPLPVCKQLCTERQKSWWDAVCTLIHRKAVPGNSAKLRLLVQHEINTLRAQEKHGLQPALLVHWAKCLQKMGSGLNSFYDQREYIGRSVHYWKKVLPLLKIIKKKNSIPEPIDPLFKHFHSVDIQASEIVEYEEDAHVTFAILDAVNGNIEDAMTAFESIKSVVSYWNLALIFHRKAEDIANDALSPEEQEECKNYLRKTRGYLIKILDDSDSNLSVVKKLPVPLESVKEMLKSVMQELENYSEGGPLYKNGSLRNADSEIKHSTPSPTKYSLSPSKSYKYSPKTPPRWAEDQNSLLKMIRQEVKAIKEEMQELKLNSSKSASHHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKSEKPLENDTGLQAQDISGRKKGRGVIFGQTSSTFTFADVAKSTSGEGFQFGKKDLNFKGFSGAGEKLFSSQYGKMANKANTSGDFEKDDDAYKTEDSDDIHFEPVVQMPEKVELVTGEEGEKVLYSQGVKLFRFDAEVSQWKERGLGNLKILKNEVNGKVRMLMQREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGSESKVEPKKCELSKNSDIEQSSDSKVKNLSASFPTEESSINYTFKTPEKEPPLWYAEFTKEELVQKLSSTTKSADHLNGLLREIEATNAVLMEQIKLLKSEIRRLERNQEQEVSAANVEHLKNVLLQFIFLKPGSERERLLPVINTMLQLSLEEKGKLAAVAQGEE

SEQ ID NO: 60914 - protein, 140 aa, Homo sapiens
TEESSINYTFKTPEKEPPLWYAEFTKEELVQKLSSTTKSADHLNGLLREIEATNAVLMEQIKLLKSEIRRLERNQEQEVSAANVEHLKNVLLQFIFLKPGSERERLLPVINTMLQLSLEEKGKLAAVAQGLQETSIPKKK

SEQ ID NO: 60915 - protein, 1758 aa, Homo sapiens
MSCSKAYGERYVASVQGSAPSPRKKSTRGFYFAKLYYEAKEYDLAKKYICTYINVREMDPRAHRFLGLLYELEENTEKAVECYRRSVELNPTQKDLVLKIAELLCKNDVTDGRAEYWVERAAKLFPGSPAIYKLKEQLLDCEGEDGWNKLFDLIQSELYVRPDDVHVNIRLVELYRSTKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWRALSELAALCYLIAFQVPRPKIKLIKGEAGQNLLEMMACDRLSQSGHMLLNLSRGKQDFLKVVVETFANKSGQSALYDALFSSQSPKDTSFLGSDDIGNIDVQEPELEDLARYDVGAIRAHNGSLQHLTWLGLQWNSLPALPGIRKWLKQLFHHLPQETSRLETNAPESICILDLEVFLLGVVYTSHLQLKEKCNSHHSSYQPLCLPLPVCKQLCTERQKSWWDAVCTLIHRKAVPGNSAKLRLLVQHEINTLRAQEKHGLQPALLVHWAKCLQKMGSGLNSFYDQREYIGRSVHYWKKVLPLLKIIKKKNSIPEPIDPLFKHFHSVDIQASEIVEYEEDAHVTFAILDAVNGNIEDAMTAFESIKSVVSYWNLALIFHRKAEDIANDALSPEEQEECKNYLRKTRGYLIKILDDSDSNLSVVKKLPVPLESVKEMLKSVMQELENYSEGGPLYKNGSLRNADSEIKHSTPSPTKYSLSPSKSYKYSPKTPPRWAEDQNSLLKMIRQEVKAIKEEMQELKLNSSKSASHHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKSEKPLENDTGLQAQDISGRKKGRGVIFGQTSSTFTFADVAKSTSGEGFQFGKKDLNFKGFSGAGEKLFSSQYGKMANKANTSGDFEKDDDAYKTEDSDDIHFEPVVQMPEKVELVTGEEGEKVLYSQGVKLFRFDAEVSQWKERGLGNLKILKNEVNGKVRMLMQREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVAEEENKGSGTGAAGASDTTIKPNAENTGPTLEWDNYDLREDALDDSVSSSSVHASPLASSPVRKNLFHFDESTTGSNFSFKSALSLSKSPAKLNQSGTSVGTDEESDVTQEEERDGQYFEPVVPLPDLVEVSSGEENEQVVFSHRAEFYRYDKDVGQWKERGIGDIKILQNYDNKHVRILMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWYAEFTKEELVQKLSSTTKSADHLNGLLREIEATNAVLMEQIKLLKSEIRRLERNQEQEVSAANVEHLKNVLLQFIFLKPGSERERLLPVINTMLQLSLEEKGKLAAVAQGEE

SEQ ID NO: 60916 - protein, 1766 aa, Homo sapiens
MSCSKAYGERYVASVQGSAPSPRKKSTRGFYFAKLYYEAKEYDLAKKYICTYINVREMDPRAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWRALSELAALCYLIAFQVPRPKIKLIKGEAGQNLLEMMACDRLSQSGHMLLNLSRGKQDFLKVVVETFANKSGQSALYDALFSSQSPKDTSFLGSDDIGNIDVQEPELEDLARYDVGAIRAHNGSLQHLTWLGLQWNSLPALPGIRKWLKQLFHHLPQETSRLETNAPESICILDLEVFLLGVVYTSHLQLKEKCNSHHSSYQPLCLPLPVCKQLCTERQKSWWDAVCTLIHRKAVPGNSAKLRLLVQHEINTLRAQEKHGLQPALLVHWAKCLQKMGSGLNSFYDQREYIGRSVHYWKKVLPLLKIIKKKNSIPEPIDPLFKHFHSVDIQASEIVEYEEDAHVTFAILDAVNGNIEDAMTAFESIKSVVSYWNLALIFHRKAEDIANDALSPEEQEECKNYLRKTRGYLIKILDDSDSNLSVVKKLPVPLESVKEMLKSVMQELENYSEGDPLYKNGSLRNADSEIKHSTPSPTKYSLSPSKSYKYSPKTPPRWAEDQNSLLKMIRQEVKAIKEEMQELKLNSSKSASHHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKESEKPLENDTGFQAQDISGQKNGRGVIFGQTSSTFTFADVAKSTSGEGFQFGKKDPNFKGFSGAGEKLFSSQCGKMANKANTSGDFEKDDDAYKTEDSDDIHFEPVVQMPEKVELVIGEEGEKVLYSQGVKLFRFDAEVRQWKERGLGNLKILKNEVNGKPRMLMRREQVLKVCANHWITTTMNLKPLSGSDRAWMWSASDFSDGDAKLERLAAKFKTPELAEEFKQKFEECQQLLLDIPLQTPHKLVDTGRAAKLIQRAEEMKSGLKDFKTFLTNDQTKVTEEENKGSGTGAAGASDTTIKPNPENTGPTLEWDNCDLREDALDDSVSSSSVHASPLASSPVRKNLFHFGESTTGSNFSFKSALSPSKSPAKLNQSGTSVGTDEESDVTQEEERDGQYFEPVVPLPDLVEVSSGEENEKVVFSHRAELYRYDKDVGQWKERGIGDIKILQNYDNKQVRIVMRRDQVLKLCANHTITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSKPFAFGNSSATGSLFGFSFNASLKSNNSETSSVAQSGSESKVEPKKCELSKNSDIEQSSDSKVKNLSASFPMEESSINYTFKTPEKEPPLWHAEFTKEELVQKLSSTTKSADHLNGLLREAEATSAVLMEQIKLLKSEIRRLERNQEQEESAANVEHLKNVLLQFIFLKPGSERERLLPVINTMLQLSPEEKGKLAAVAQAERGFVLNSTF

SEQ ID NO: 60917 - protein, 1125 aa, Homo sapiens
MLLTLSTRDVQESRELLESFDSALQSAKSSLGGNDELSATFLEMKGHFYMHAGSLLLKMGQHGNNVQWRALSELAALCYLIAFQVPRPKIKLIKGEAGQNLLEMMACDRLSQSGHMLLNLSRGKQDFLKVVVETFANKSGQSALYDALFSSQSPKDTSFLGSDDIGNIDVQEPELEDLARYDVGAIRAHNGSLQHLTWLGLQWNSLPALPGIRKWLKQLFHHLPQETSRLETNAPESICILDLEVFLLGVVYTSHLQLKEKCNSHHSSYQPLCLPLPVCKQLCTERQKSWWDAVCTLIHRKAVPGNSAKLRLLVQHEINTLRAQEKHGLQPALLVHWAKCLQKMGSGLNSFYDQREYIGRSVHYWKKVLPLLKIIKKKNSIPEPIDPLFKHFHSVDIQASEIVEYEEDAHVTFAILDAVNGNIEDAMTAFESIKSVVSYWNLALIFHRKAEDIANDALSPEEQEECKNYLRKTRGYLIKILDDSDSNLSVVKKLPVPLESVKEMLKSVMQELENYSEGDPLYKNGSLRNADSEIKHSTPSPTKYSLSPSKSYKYSPKTPPRWAEDQNSLLKMIRQEVKAIKEEMQELKLNSSKSASHHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKESEKPLENDTGFQAQDISGQKNGRGVIFGQTSSTFTFADVAKSTSGEGFQFGKKDPNFKGFSGAGEKLFSSQCGKMANKANTSGDFEKDDDAYKTEDSDDIHFEPVVQMPEKVELVIGEEGEKVLYSQGVKLFRFDAEVRQWKERGLGNLKILKNEVNGKPRMLMRREQVLKVCANHWITTTMNLKPLSGSDRAWMWSASDFSDGDAKLERLAAKFKTPELAEEFKQKFEECQQLLLDIPLQTPHKLVDTGRAAKLIQRAEEMKSGSESKVEPKKCELSKNSDIEQSSDSKVKNLSASFPMEESSINYTFKTPEKEPPLWHAEFTKEELVQKLSSTTKSADHLNGLLREAEATSAVLMEQIKLLKSEIRRLERNQEQEESAANVEHLKNVLLQFIFLKPGSERERLLPVINTMLQLSPEEKGKLAAVAQGEE

SEQ ID NO: 60918 - protein, 156 aa, Homo sapiens
MDPRAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVARCHEAERNIALRSSLEWNSCVVQTLKF

SEQ ID NO: 60919 - protein, 1758 aa, Homo sapiens
MSCSKAYGERYVASVQGSAPSPRKKSTRGFYFAKLYYEAKEYDLAKKYICTYINVREMDPRAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWRALSELAALCYLIAFQVPRPKIKLIKGEAGQNLLEMMACDRLSQSGHMLLNLSRGKQDFLKVVVETFANKSGQSALYDALFSSQSPKDTSFLGSDDIGNIDVQEPELEDLARYDVGAIRAHNGSLQHLTWLGLQWNSLPALPGIRKWLKQLFHHLPQETSRLETNAPESICILDLEVFLLGVVYTSHLQLKEKCNSHHSSYQPLCLPLPVCKQLCTERQKSWWDAVCTLIHRKAVPGNSAKLRLLVQHEINTLRAQEKHGLQPALLVHWAKCLQKMGSGLNSFYDQREYIGRSVHYWKKVLPLLKIIKKKNSIPEPIDPLFKHFHSVDIQASEIVEYEEDAHVTFAILDAVNGNIEDAMTAFESIKSVVSYWNLALIFHRKAEDIANDALSPEEQEECKNYLRKTRGYLIKILDDSDSNLSVVKKLPVPLESVKEMLKSVMQELENYSEGDPLYKNGSLRNADSEIKHSTPSPTKYSLSPSKSYKYSPKTPPRWAEDQNSLLKMIRQEVKAIKEEMQELKLNSSKSASHHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKESEKPLENDTGFQAQDISGQKNGRGVIFGQTSSTFTFADVAKSTSGEGFQFGKKDPNFKGFSGAGEKLFSSQCGKMANKANTSGDFEKDDDAYKTEDSDDIHFEPVVQMPEKVELVIGEEGEKVLYSQGVKLFRFDAEVRQWKERGLGNLKILKNEVNGKPRMLMRREQVLKVCANHWITTTMNLKPLSGSDRAWMWSASDFSDGDAKLERLAAKFKTPELAEEFKQKFEECQQLLLDIPLQTPHKLVDTGRAAKLIQRAEEMKSGLKDFKTFLTNDQTKVTEEENKGSGTGAAGASDTTIKPNPENTGPTLEWDNCDLREDALDDSVSSSSVHASPLASSPVRKNLFHFGESTTGSNFSFKSALSPSKSPAKLNQSGTSVGTDEESDVTQEEERDGQYFEPVVPLPDLVEVSSGEENEKVVFSHRAELYRYDKDVGQWKERGIGDIKILQNYDNKQVRIVMRRDQVLKLCANHTITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSKPFAFGNSSATGSLFGFSFNASLKSNNSETSSVAQSGSESKVEPKKCELSKNSDIEQSSDSKVKNLSASFPMEESSINYTFKTPEKEPPLWHAEFTKEELVQKLSSTTKSADHLNGLLREAEATSAVLMEQIKLLKSEIRRLERNQEQEESAANVEHLKNVLLQFIFLKPGSERERLLPVINTMLQLSPEEKGKLAAVAQGEE

SEQ ID NO: 60920 - protein, 1765 aa, Homo sapiens
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWQATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKREKPLENDTGFQAQDISGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGAAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAILEETTRERTDVIQGDDVADAASEVEVSSTSETTTKAVVSPPKFVFVSESVKRIFSSEKSKPFVFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQDEEENASRSSG

SEQ ID NO: 60921 - protein, 904 aa, Homo sapiens
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWQATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTEAAHRHFTIEKHGDSKWIIYRFTKQLCGTERARAKIS

SEQ ID NO: 60922 - protein, 152 aa, Homo sapiens
MWSGTSPRCWVSPRRLDRYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRL

SEQ ID NO: 60923 - protein, 904 aa, Homo sapiens; identical to SEQ ID NO: 60921

SEQ ID NO: 60924 - protein, 1765 aa, Homo sapiens; identical to SEQ ID NO: 60920

SEQ ID NO: 60925 - protein, 904 aa, Homo sapiens; identical to SEQ ID NO: 60921

SEQ ID NO: 60926 - protein, 1765 aa, Homo sapiens
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWRATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAILDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKREKPLENDTGLQAQDIRGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGVAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEEITRERTDVIQGDDVADAASEVEVSSTSETTTKAVVSPPKFVFVSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQDEEENPSRSSG

SEQ ID NO: 60927 - protein, 468 aa, Homo sapiens
MGTATPDGREDQERLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 60928 - protein, 510 aa, Homo sapiens
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 60929 - protein, 336 aa, Homo sapiens
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRSACRAPSATARRRRSPAPSLTTPTRARASCWRGRSRRS

SEQ ID NO: 60930 - protein, 263 aa, Homo sapiens
MDEKTKKAEEMALSLTRAVAGGDEQVAMKCAIWLAEQRVPLSVQLKPEVSPTQDIRSRGEKTEEVGEVREVPDHGGPRVLPRVDSKSSVEPLEGPNWLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPE

SEQ ID NO: 60931 - protein, 272 aa, Homo sapiens
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQGVPAGHHPQQPGGGGLLPLH

SEQ ID NO: 60932 - protein, 117 aa, Homo sapiens
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSH

SEQ ID NO: 60933 - protein, 255 aa, Homo sapiens
  MOD_RES (1)..(1): Any amino acid
XEMALSLTRAVAGGDEQVAMKCAIWLAEQRVPLSVQLKPEVSPTQDIRSRGEKTEEVGEVREVPDHGGPRVLPRVDSKSSVEPLEGPNWLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPE

SEQ ID NO: 60934 - protein, 272 aa, Homo sapiens; identical to SEQ ID NO: 60931

SEQ ID NO: 60935 - protein, 1609 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRKKRWRSLGSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKQRVLESTPAESSEGLDPKDATDPVYKTVTSSTEKGLIVYCVTSPKKDDRYREPPPTPPGYLGISLADLKEGPHTHLKPPDYSVAVQRSKMMHNSLSRLPPASLSSNLVACVPSKIVTQPQRHNLQPFHPKLGDVTDADSEADENEQVSAV

SEQ ID NO: 60936 - protein, 1509 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSAVGFYYIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRKKRWRSLGSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKQRVLESTPAESSEGLDPKDATDPVYKTVTSSTEKGLIENEQVSAV

SEQ ID NO: 60937 - protein, 1509 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSAKGFKNIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRKKRWRSLGSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKQRVLESTPAESSEGLDPKDATDPVYKTVTSSTEKGLIGKKQTSYF

SEQ ID NO: 60938 - protein, 1504 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRKKRWRSLGSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKQRVLESTPAESSEGLDPKDATDPVYKTVTSSTEKGLIENEQVSAV

SEQ ID NO: 60939 - protein, 1601 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKQRVLESTPAESSEGLDPKDATDPVYKTVTSSTEKGLIVYCVTSPKKDDRYREPPPTPPGYLGISLADLKEGPHTHLKPPDYSVAVQRSKMMHNSLSRLPPASLSSNLVACVPSKIVTQPQRHNLQPFHPKLGDVTDADSEADENEQVSAV

SEQ ID NO: 60940 - protein, 1204 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALM

SEQ ID NO: 60941 - protein, 1391 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKVGSIISDHSSKISGQSCPGIGGAYLQKKILQITRSTAKRTDSTEKATEENRDRTSCENTTRKRMTSPFRRLRERMLSRERLVNSQKEDTDHNQATESCEKVKDVGSNIKDEKGSAIFNSNSQGNSNTLNCFYTRFKSKRRKTL

SEQ ID NO: 60942 - protein, 827 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGR

SEQ ID NO: 60943 - protein, 516 aa, Homo sapiens
MADNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSQSSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 60944 - protein, 608 aa, Homo sapiens
MADNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHEGRSAVDQAGGAQIVIDHLRSLCSITDPANEKLLTVFCGMLMNYSNENDSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 60945 - protein, 559 aa, Homo sapiens
MADNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 60946 - protein, 558 aa, Homo sapiens
MDNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 60947 - protein, 607 aa, Homo sapiens
MDNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHEGRSAVDQAGGAQIVIDHLRSLCSITDPANEKLLTVFCGMLMNYSNENDSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 60948 - protein, 607 aa, Homo sapiens
MADNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHEGRSAVDQAGGAQIVIDHLRSLCSITDPANEKLLTVFCGMLMNYSNENDSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 60949 - protein, 184 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 60950 - protein, 184 aa, Homo sapiens; identical to SEQ ID NO: 60949

SEQ ID NO: 60951 - protein, 118 aa, Homo sapiens
MRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 60952 - protein, 184 aa, Homo sapiens; identical to SEQ ID NO: 60949

SEQ ID NO: 60953 - protein, 32 aa, Homo sapiens
MREYKLVVLGSGGVGKSALTVQFVQGIFVEKY

SEQ ID NO: 60954 - protein, 142 aa, Homo sapiens
MREYKLVVLGSGGVGKSALEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 60955 - protein, 127 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVG

SEQ ID NO: 60956 - protein, 142 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVGKEQGQNLDNGTTVHS

SEQ ID NO: 60957 - protein, 48 aa, Homo sapiens
MREYKLVVLGSGGVGKSALTVQFVQGIFVEKYDPTIEDSYRKQVEVDA

SEQ ID NO: 60958 - protein, 11 aa, Homo sapiens
MREYKLVVLGS

SEQ ID NO: 60959 - protein, 87 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQ

SEQ ID NO: 60960 - protein, 184 aa, Homo sapiens; identical to SEQ ID NO: 60949

SEQ ID NO: 60961 - protein, 101 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQIL

SEQ ID NO: 60962 - protein, 53 aa, Homo sapiens
MREYKLVVLGSGGVGKSALTVQFVQGIFVEKYDPTIEDSYRKQVEVDAQQCML

SEQ ID NO: 60963 - protein, 142 aa, Homo sapiens; identical to SEQ ID NO: 60954

SEQ ID NO: 60964 - protein, 165 aa, Homo sapiens
MREYKLVVLGSGGVGKSALTVQFVQGIFVEKYDPTIEDSYRKEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 60965 - protein, 139 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVGKEQGQNLARQWN

SEQ ID NO: 60966 - protein, 93 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDL

SEQ ID NO: 60967 - protein, 11 aa, Homo sapiens
MREYKLVVLGS

SEQ ID NO: 60968 - protein, 98 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLRE

SEQ ID NO: 60969 - protein, 137 aa, Homo sapiens
MREYKLVVLGSGGVGKSALTVQFVQGIFVEKYDPTIEDSYRKQVEVDAQQCMLEILDTAGTVPMILVGNKCDLEDERVVGKEQGQNLARQWNNCAFLESSAKSKINVNEIFYDLVRQINRKTPVPGKARKKSSCQLL

SEQ ID NO: 60970 - protein, 118 aa, Homo sapiens; identical to SEQ ID NO: 60951

SEQ ID NO: 60971 - protein, 122 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLED

SEQ ID NO: 60972 - protein, 85 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSIT

SEQ ID NO: 60973 - protein, 183 aa, Homo sapiens
MREYKVVVLGSGGVGKSALTVQFVTGTFIEKYDPTIEDFYRKEIEVDSSPSVLEILDTAGTEQFASMRDLYIKNGQGFILVYSLVNQQSFQDIKPMRDQIIRVKRYEKVPVILVGNKVDLESEREVSSSEGRALAEEWGCPFMETSAKSKTMVDELFAEIVRQMNYAAQPDKDDPCCSACNIQ

SEQ ID NO: 60974 - protein, 556 aa, Homo sapiens
MNEGAPGDSDLETEARVPWSIMGHCLRTGQARMSATPTPAGEGARRDELFGILQILHQCILSSGDAFVLTGVCCSWRQNGKPPYSQKEDKEVQTGYMNAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 60975 - protein, 548 aa, Homo sapiens
MNEGAPGDSDLETEARVPWSIMGHCLRTGQARMSATPTPAGEGARSSSTCSSLSRLFWSQLEHINWDGATAKNFINLREFFSFLLPALRKAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 60976 - protein, 523 aa, Homo sapiens
MESAPAAPDPAASEPGSSGADAAAGSRETPLNQESARKSEPPAPVRRQSYSSTSRGISVTKKTHTSQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 60977 - protein, 468 aa, Homo sapiens
MMYFVIAAMKAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 60978 - protein, 518 aa, Homo sapiens
MDRAPQRQHRASRELLAAKKTHTSQIEVIPCKICGDKSSGIHYGVITCEGCKGFFRRSQRCNAAYSCTRQQNCPIDRTSRNRCQHCRLQKCLALGMSRDAVKFGRMSKKQRDSLHAEVQKQLQQRQQQQQEPVVKTPPAGAQGADTLTYTLGLPDGQLPLGSSPDLPEASACPPGLLKASGSGPSYSNNLAKAGLNGASCHLEYSPERGKAEGRESFYSTGSQLTPDRCGLRFEEHRHPGLGELGQGPDSYGSPSFRSTPEAPYASLTEIEHLVQSVCKSYRETCQLRLEDLLRQRSNIFSREEVTGYQRKSMWEMWERCAHHLTEAIQYVVEFAKRLSGFMELCQNDQIVLLKAGAMEVVLVRMCRAYNADNRTVFFEGKYGGMELFRALGCSELISSIFDFSHSLSALHFSEDEIALYTALVLINAHRPGLQEKRKVEQLQYNLELAFHHHLCKTHRQSILAKLPPKGKLRSLCSQHVERLQIFQHLHPIVVQAAFPPLYKELFSTETESPVGLSK

SEQ ID NO: 60979 - protein, 497 aa, Homo sapiens
MRTQIEVIPCKICGDKSSGIHYGVITCEGCKGFFRRSQRCNAAYSCTRQQNCPIDRTSRNRCQHCRLQKCLALGMSRDAVKFGRMSKKQRDSLHAEVQKQLQQRQQQQQEPVVKTPPAGAQGADTLTYTLGLPDGQLPLGSSPDLPEASACPPGLLKASGSGPSYSNNLAKAGLNGASCHLEYSPERGKAEGRESFYSTGSQLTPDRCGLRFEEHRHPGLGELGQGPDSYGSPSFRSTPEAPYASLTEIEHLVQSVCKSYRETCQLRLEDLLRQRSNIFSREEVTGYQRKSMWEMWERCAHHLTEAIQYVVEFAKRLSGFMELCQNDQIVLLKAGAMEVVLVRMCRAYNADNRTVFFEGKYGGMELFRALGCSELISSIFDFSHSLSALHFSEDEIALYTALVLINAHRPGLQEKRKVEQLQYNLELAFHHHLCKTHRQSILAKLPPKGKLRSLCSQHVERLQIFQHLHPIVVQAAFPPLYKELFSTETESPVGLSK

SEQ ID NO: 60980 - protein, 572 aa, Homo sapiens
MWGTGPSAGKDRMSGRPWPHPWSKSGTPSEQDRRATGLVSCEHGGGKFEGQSHQAPGPPGGGRTGCLELLAAKKTHTSQIEVIPCKICGDKSSGIHYGVITCEGCKGFFRRSQRCNAAYSCTRQQNCPIDRTSRNRCQHCRLQKCLALGMSRDAVKFGRMSKKQRDSLHAEVQKQLQQRQQQQQEPVVKTPPAGAQGADTLTYTLGLPDGQLPLGSSPDLPEASACPPGLLKASGSGPSYSNNLAKAGLNGASCHLEYSPERGKAEGRESFYSTGSQLTPDRCGLRFEEHRHPGLGELGQGPDSYGSPSFRSTPEAPYASLTEIEHLVQSVCKSYRETCQLRLEDLLRQRSNIFSREEVTGYQRKSMWEMWERCAHHLTEAIQYVVEFAKRLSGFMELCQNDQIVLLKAGAMEVVLVRMCRAYNADNRTVFFEGKYGGMELFRALGCSELISSIFDFSHSLSALHFSEDEIALYTALVLINAHRPGLQEKRKVEQLQYNLELAFHHHLCKTHRQSILAKLPPKGKLRSLCSQHVERLQIFQHLHPIVVQAAFPPLYKELFSTETESPVGLSK

SEQ ID NO: 60981 - protein, 944 aa, Homo sapiens
MLDSFSQESTLPFREARKRTSFQPVQVWRNFTASQTTESPACSGASLGEMTAWTMGARGLDKRGSFFKLIDTIASEIGELKQEMVRTDVNLENGLEPAETHSMVRHKDGGYSEEEDVKTCARDSGYDSLSNRLSILDRLLHTHPIWLQLSLSEEEAAEVLQAQPPGIFLVHKSTKMQKKVLSLRLPCEFGAPLKEFAIKESTYTFSLEGSGISFADLFRLIAFYCISRDVLPFTLKLPYAISTAKSEAQLEELAQMGLNFWSSPADSKPPNLPPPHRPLSSDGVCPASLRQLCLINGVHSIKTRTPSELECSQTNGALCFINPLFLKVHSQDLSGGLKRPSTRTPNANGTERTRSPPPRPPPPAINSLHTSPRLARTETQTSMPETVNHNKHGNVALPGTKPTPIPPPRLKKQASFLEAEGGAKTLSGGRPGAGPELELGTAGSPGGAPPEAAPGDCTRAPPPSSESRPPCHGGRQRLSDMSISTSSSDSLEFDRSMPLFGYEADTNSSLEDYEGESDQETMAPPIKSKKKRSSSFVLPKLVKSQLQKVSGVFSSFMTPEKRMVRRIAELSRDKCTYFGCLVQDYVSFLQENKECHVSSTDMLQTIRQFMTQVKNYLSQSSELDPPIESLIPEDQIDVVLEKAMHKCILKPLKGHVEAMLKDFHMADGSWKQLKENLQLVRQRNPQELGVFAPTPDFVDVEKIKVKFMTMQKMYSPEKKVMLLLRVCKLIYTVMENNSGRMYGADDFLPVLTYVIAQCDMLELDTEIEYMMELLDPSLLHGEGGYYLTSAYGALSLIKNFQEEQAARLLSSETRDTLRQWHKRRTTNRTIPSVDDFQNYLRVAFQEVNSGCTGKTLLVRPYITTEDVCQICAEKFKVGDPEEYSLFLFVDETWQQLAEDTYPQKIKAELHSRPQPHIFHFVYKRIKNDPYGIIFQNGEEDLTTS

SEQ ID NO: 60982 - protein, 462 aa, Homo sapiens
MTAWTMGARGLDKRGSFFKLIDTIASEIGELKQEMVRTDVNLENGLEPAETHSMVRHKDGGYSEEEDVKTCARDSGYDSLSNRLSILDRLLHTHPIWLQLSLSEEEAAEVLQAQPPGIFLVHKSTKMQKKVLSLRLPCEFGAPLKEFAIKESTYNVVLEKAMHKCILKPLKGHVEAMLKDFHMADGSWKQLKENLQLVRQRNPQELGVFAPTPDFVDVEKIKVKFMTMQKMYSPEKKVMLLLRVCKLIYTVMENNSGRMYGADDFLPVLTYVIAQCDMLELDTEIEYMMELLDPSLLHGEGGYYLTSAYGALSLIKNFQEEQAARLLSSETRDTLRQWHKRRTTNRTIPSVDDFQNYLRVAFQEVNSGCTGKTLLVRPYITTEDVCQICAEKFKVGDPEEYSLFLFVDETWQQLAEDTYPQKIKAELHSRPQPHIFHFVYKRIKNDPYGIIFQNGEEDLTTS

SEQ ID NO: 60983 - protein, 238 aa, Homo sapiens
MSSGYSSLEEDAEDFFFTARTSFFRRAPQGKPRSGQQDVEKEKETHSYLSKEEIKEKVHKYNLAVTDKLKMTLNSNGIYTGFIKVQMELCKPPQTSPNSGKLSPSSNGCMNTLHISSTNTVGEVIEALLKKFLVTESPAKFALYKRCHREDQVYACKLSDREHPLYLRLVAGPRTDTLSFVLREHEIGEWEAFSLPELQNFLRILDKEEDEQLQNLKRRYTAYRQKLEEALREVWKPD

SEQ ID NO: 60984 - protein, 168 aa, Homo sapiens
MTLNSNGIYTGFIKVQMELCKPPQTSPNSGKLSPSSNGCMNTLHISSTNTVGEVIEALLKKFLVTESPAKFALYKRCHREDQVYACKLSDREHPLYLRLVAGPRTDTLSFVLREHEIGEWEAFSLPELQNFLRILDKEEDEQLQNLKRRYTAYRQKLEEALREVWKPD

SEQ ID NO: 60985 - protein, 238 aa, Homo sapiens; identical to SEQ ID NO: 60983

SEQ ID NO: 60986 - protein, 337 aa, Homo sapiens
MTMMAHQYPSWIFINEKTFITREQLNSLLKTYNIFYENQKNLHILYGETEDGKLIVEGMLDIFWGVKRPIQLKIQDEKPFSSFTSMKSSDVFSSKGMTRWGEFDDLYRISELDRTQIPMSEKRNSQEDYLSYHSNTLKPHAKDEPDSPVLYRTMSEAALVRKRMKPLMMDRKERQKNRASINGHFYNHETSIFIPAFESETKVRVNSNMRTEEVIKQLLQKFKIENSPQDFALHIIFATGEQRRLKKTDIPLLQRLLQGPSEKNARIFLMDKDAEEISSDVAQYINFHFSLLESILQRLNEEEKREIQRIVTKFNKEKAIILKCLQNKLVIKTETTV

SEQ ID NO: 60987 - protein, 325 aa, Homo sapiens
MLWEETGAAPAPARASDLPYRIHFLSSGLILVTRQLTEDGKLIVEGMLDIFWGVKRPIQLKIQDEKPFSSFTSMKSSDVFSSKGMTRWGEFDDLYRISELDRTQIPMSEKRNSQEDYLSYHSNTLKPHAKDEPDSPVLYRTMSEAALVRKRMKPLMMDRKERQKNRASINGHFYNHETSIFIPAFESETKVRVNSNMRTEEVIKQLLQKFKIENSPQDFALHIIFATGEQRRLKKTDIPLLQRLLQGPSEKNARIFLMDKDAEEISSDVAQYINFHFSLLESILQRLNEEEKREIQRIVTKFNKEKAIILKCLQNKLVIKTETTV

SEQ ID NO: 60988 - protein, 369 aa, Homo sapiens
MLWEETGAAPAPARASDLPYRISSDHLKKEEKMTMMAHQYPSWIFINEKTFITREQLNSLLKTYNIFYENQKNLHILYGETEDGKLIVEGMLDIFWGVKRPIQLKIQDEKPFSSFTSMKSSDVFSSKGMTRWGEFDDLYRISELDRTQIPMSEKRNSQEDYLSYHSNTLKPHAKDEPDSPVLYRTMSEAALVRKRMKPLMMDRKERQKNRASINGHFYNHETSIFIPAFESETKVRVNSNMRTEEVIKQLLQKFKIENSPQDFALHIIFATGEQRRLKKTDIPLLQRLLQGPSEKNARIFLMDKDAEEISSDVAQYINFHFSLLESILQRLNEEEKREIQRIVTKFNKEKAIILKCLQNKLVIKTETTV

SEQ ID NO: 60989 - protein, 303 aa, Homo sapiens
MTMMAHQYPSWIFINEKTFITREQLNSLLKTYNIFYENQKNLHILYGETEDGKLIVEGMLDIFWGVKRPIQLKIQDEKPFSSFTSMKSSDVFSSKGMTRWGEFDDLYRISELDRTQIPMSEKRNSQEDYLSYHSNTLKPHAKDEPDSPVLYRTMSEAALVRKRMKPLMMDRKERQKNRASINGHFYNHEIENSPQDFALHIIFATGEQRRLKKTDIPLLQRLLQGPSEKNARIFLMDKDAEEISSDVAQYINFHFSLLESILQRLNEEEKREIQRIVTKFNKEKAIILKCLQNKLVIKTETTV

SEQ ID NO: 60990 - protein, 1046 aa, Homo sapiens
MLSRTLSYKYRDLDSTFSSLGASDDPAELSTQLSAPGVLKVFGDSVCTGTHYKSVLATGTSSARELVKEALERYALDPRQAGQYVLCDVVGQAGDAGQRWQARCFRVFGDSEKPLLIQELWKPREGLSRRFELRKRSDVEELAAKEVDTITAGINAQARRLQRSRAKGTPTPALGDARSSPPPRLRRTVSETSLSPVNALPAAAQGPEEPGPDAMRYSLYQSPHLLLLQGYSQQHPGVCAQPGPAHGGPADPSKPSISLSAPDILPLHCTIRRQPLPDSGQAAGRLVLEPIPGAHISVNFSEVGHRTVVLHHGDLLSLGLYYLLLFKDPAQAQPLPARALARLRAVPQSCRLCGAALGARGAASPTQAALPRRQQLLLEFEPHLEDTLLQRIMTLIEPGGDDHKLTPAFLLCLCIQHSATHFQPGTFGQLLLKIARLIRETVWEKTKELAEKQAQLQEPISLASCAMADLVPDLQPILFWMSNSIELLYFIQQKCPLYMQSMEEQLDITGSKESLFSCTLTASEEAMAVLEEVVLYAFQQCVYYVSKSLYICLPALLECPPFQTERRESWSSAPELPEELRRVVSVYQAALDLLRQLQVHPEVASQMLAYLFFFSGTLLLNQLLDRGPSLSCFHWPRGVQACARLQQLLEWMRSAGFGAAGEHFFQKLSCTLNLLATPRAQLIQMSWTALRAAFPALSPAQLHRLLTHYQLASAMGPMSTWEPGAQDSPEAFRSEDVLESYENPPPIVLPSDGFQVDLEANCLDDSIYQHLLYVRHFLWGLRSRASPGSPGRPGSGASQPVCPEGMHHVVLDGHLEAPSCPLAPRDPGPAAREVAPERTLPLRGAPWAQAPPGRQPSRGGSQAGPPHTDSSCLLTPPSTPLGPEPGDPDWPESGGPCGKALPERQRNGLSGLRGAAPEGDSAALAEESPPAPSSRSSSTEDFCYVFTVELERGPSGLGMGLIDGMHTHLGAPGLYIQTLLPGSPAAADGRLSLGDRILEVNGSSLLGLGYLRAVDLIRHGGKKMRFLVAKSDVETAKKIHFRTPPL

SEQ ID NO: 60991 - protein, 1075 aa, Homo sapiens
MFYGTHFIMSPPTKSKLKRQSQLLSSMLSRTLSYKYRDLDSTFSSLGASDDPAELSTQLSAPGVLKVFGDSVCTGTHYKSVLATGTSSARELVKEALERYALDPRQAGQYVLCDVVGQAGDAGQRWQARCFRVFGDSEKPLLIQELWKPREGLSRRFELRKRSDVEELAAKEVDTITAGINAQARRLQRSRAKGTPTPALGDARSSPPPRLRRTVSETSLSPVNALPAAAQGPEEPGPDAMRYSLYQSPHLLLLQGYSQQHDSLVYVLNRDRHTVGQRTPSSKPSISLSAPDILPLHCTIRRQPLPDSGQAAGRLVLEPIPGAHISVNFSEVGHRTVVLHHGDLLSLGLYYLLLFKDPAQAQPLPARALARLRAVPQSCRLCGAALGARGAASPTQAALPRRQQLLLEFEPHLEDTLLQRIMTLIEPGGDDHKLTPAFLLCLCIQHSATHFQPGTFGQLLLKIARLIRETVWEKTKELAEKQAQLQEPISLASCAMADLVPDLQPILFWMSNSIELLYFIQQKCPLYMQSMEEQLDITGSKESLFSCTLTASEEAMAVLEEVVLYAFQQCVYYVSKSLYICLPALLECPPFQTERRESWSSAPELPEELRRVVSVYQAALDLLRQLQVHPEVASQMLAYLFFFSGTLLLNQLLDRGPSLSCFHWPRGVQACARLQQLLEWMRSAGFGAAGEHFFQKLSCTLNLLATPRAQLIQMSWTALRAAFPALSPAQLHRLLTHYQLASAMGPMSTWEPGAQDSPEAFRSEDVLESYENPPPIVLPSDGFQVDLEANCLDDSIYQHLLYVRHFLWGLRSRASPGSPGRPGSGASQPVCPEGMHHVVLDGHLEAPSCPLAPRDPGPAAREVAPERTLPLRGAPWAQAPPGRQPSRGGSQAGPPHTDSSCLLTPPSTPLGPEPGDPDWPESGGPCGKALPERQRNGLSGLRGAAPEGDSAALAEESPPAPSSRSSSTEDFCYVFTVELERGPSGLGMGLIDGMHTHLGAPGLYIQTLLPGSPAAADGRLSLGDRILEVNGSSLLGLGYLRAVDLIRHGGKKMRFLVAKSDVETAKKIHFRTPPL

SEQ ID NO: 60992 - protein, 134 aa, Homo sapiens
MFYGTHFIMSPPTKSKLKRQSQLLSSMLSRTLSYKYRDLDSTFSSLGASDDPAELSTQLSAPGVLKVFGDSVCTGTHYKSVLATGTSSARELVKEALERYALDPRQAGQYVLCDVVGQAGDAGQRWQARCFRVF

SEQ ID NO: 60993 - protein, 542 aa, Homo sapiens
MFYGTHFIMSPPTKSKLKRQSQLLSSMLSRTLSYKYRDLDSTFSSLGASDDPAELSTQLSAPGVLKVFGDSVCTGTHYKSVLATGTSSARELVKEALERYALDPRQAGQYVLCDVVGQAGDAGQRWQARCFRVFGDSEKPLLIQELWKPREGLSRRFELRKRSDVEELAAKEVDTITAGINAQARRLQRSRAKGTPTPALGDARSSPPPRLRRTVSETSLSPVNALPAAAQGPEEPGPDAMRYSLYQSPHLLLLQGYSQQHDSLVYVLNRDRHTVGQRTPSSKPSISLSAPDILPLHCTIRRQPLPDSGQAAGRLVLEPIPGAHISVNFSEVGHRTVVLHHGDLLSLGLYYLLLFKDPAQAQPLPARALARLRAVPQSCRLCGAALGARGAASPTQAALPRRQQLLLEFEPHLEDTLLQRIMTLIEPGGDDHKLTPAFLLCLCIQHSATHFQPGTFGQLLLKIARLIRETVWEKTKELAEKQAQLLEGIAVLLHADGQRGGHGGAGGGGAVRLPAVRLLCLQVPVHLPPGTPGVPAIPDGAP

SEQ ID NO: 60994 - protein, 835 aa, Homo sapiens
MRYSLYQSPHLLLLQGYSQQHDSLVYVLNRDRHTVGQRTPSSKPSISLSAPDILPLHCTIRRQPLPDSGQAAGRLVLEPIPGAHISVNFSEVGHRTVVLHHGDLLSLGLYYLLLFKDPAQAQPLPARALARLRAVPQSCRLCGAALGARGAASPTQAALPRRQQLLLEFEPHLEDTLLQRIMTLIEPGGDDHKLTPAFLLCLCIQHSATHFQPGTFGQLLLKIARLIRETVWEKTKELAEKQAQLQEPISLASCAMADLVPDLQPILFWMSNSIELLYFIQQKCPLYMQSMEEQLDITGSKESLFSCTLTASEEAMAVLEEVVLYAFQQCVYYVSKSLYICLPALLECPPFQTERRESWSSAPELPEELRRVVSVYQAALDLLRQLQVHPEVASQMLAYLFFFSGTLLLNQLLDRGPSLSCFHWPRGVQACARLQQLLEWMRSAGFGAAGEHFFQKLSCTLNLLATPRAQLIQMSWTALRAAFPALSPAQLHRLLTHYQLASAMGPMSTWEPGAQDSPEAFRSEDVLESYENPPPIVLPSDGFQVDLEANCLDDSIYQHLLYVRHFLWGLRSRASPGSPGRPGSGASQPVCPEGMHHVVLDGHLEAPSCPLAPRDPGPAAREVAPERTLPLRGAPWAQAPPGRQPSRGGSQAGPPHTDSSCLLTPPSTPLGPEPGDPDWPESGGPCGKALPERQRNGLSGLRGAAPEGDSAALAEESPPAPSSRSSSTEDFCYVFTVELERGPSGLGMGLIDGMHTHLGAPGLYIQTLLPGSPAAADGRLSLGDRILEVNGSSLLGLGYLRAVDLIRHGGKKMRFLVAKSDVETAKKIHFRTPPL

SEQ ID NO: 60995 - protein, 694 aa, Homo sapiens
MCSTGTGTRWASGPPPASPASASQPPTSCLYTAPSAGNRSRTAARPRGGWLEPIPGAHISVNFSEVGHRTVVLHHGDLLSLGLYYLLLFKDPAQAQPLPARALARLRAVPQSCRLCGAALGARGAASPTQAALPRRQQLLLEFEPHLEDTLLQRIMTLIEPGGDDHKLTPAFLLCLCIQHSATHFQPGTFGQLLLKIARLIRETVWEKTKELAEKQAQLQEPISLASCAMADLVPDLQPILFWMSNSIELLYFIQQKCPLYMQSMEEQLDITGSKESLFSCTLTASEEAMAVLEEVVLYAFQQCVYYVSKSLYICLPALLECPPFQTERRESWSSAPELPEELRRVVSVYQAALDLLRQLQVHPEVASQMLAYLFFFSGTLLLNQLLDRGPSLSCFHWPRGVQACARLQQLLEWMRSAGFGAAGEHFFQKLSCTLNLLATPRAQLIQMSWTALRAAFPALSPAQLHRLLTHYQLASAMGPMSTWEPGAQDSPEAFRSEDVLESYENPPPIVLPSDGFQVDLEANCLDDSIYQHLLYVRHFLWGLRSRASPGSPGRPGSGASQPVCPEGMHHVVLDGHLEAPSCPLAPRDPGPAAREVAPERTLPLRGAPWAQAPPGRQPPGLYIQTLLPGSPAAADGRLSLGDRILEVNGSSLLGLGYLRAVDLIRHGGKKMRFLVAKSDVETAKKIHFRTPPL

SEQ ID NO: 60996 - protein, 122 aa, Homo sapiens
MKLAAMIKKMCPSDSELSIPAKNCYRMVILGSSKVGKTAIVSRFLTGRFEDAYTPTIEDFHRKFYSIRGEVYQLDILDTSGNHPFPAMRRLSILTDPRHQVLPQEQNQGERGRAPGHLRQQG

SEQ ID NO: 60997 - protein, 797 aa, Homo sapiens
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPPLTPSKPPVVVDWASGVSPKPDPKTISKHVQRMVDSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 60998 - protein, 597 aa, Homo sapiens
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYPDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHGNKYSESR

SEQ ID NO: 60999 - protein, 546 aa, Homo sapiens
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYPDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKGNKYSESR

SEQ ID NO: 61000 - protein, 762 aa, Homo sapiens
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 61001 - protein, 749 aa, Homo sapiens
MMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPPLTPSKPPVVVDWASGVSPKPDPKTISKHVQRMVDSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 61002 - protein, 481 aa, Homo sapiens
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYPDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDRSGA

SEQ ID NO: 61003 - protein, 546 aa, Homo sapiens
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKGNKYSESR

SEQ ID NO: 61004 - protein, 597 aa, Homo sapiens
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHGNKYSESR

SEQ ID NO: 61005 - protein, 609 aa, Homo sapiens
MAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAEKLLQLQNFNTLMAVVGGLSHSSISRLKETHSHVSPETIKLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTSPTSCTPPPRPPVLEEWTSAAKPKLDQALVVEHIEKMVESVFRNFDVDGDGHISQEEFQIIRGNFPYLSAFGDLDQNQDGCISREEMVSYFLRSSSVLGGRMGFVHNFQESNSLRPVACRHCKALILGIYKQGLKCRACGVNCHKQCKDRLSVECRRRAQSVSLEGSAPSPSPMHSHHHRAFSFSLPRPGRRGSRPPEIREEEVQTVEDGVFDIHL

SEQ ID NO: 61006 - protein, 610 aa, Homo sapiens
MAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAEKLLQLQNFNTLMAVVGGLSHSSISRLKETHSHVSPETIKLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTSPTSCTPPPRPPVLEEWTSAAKPKLDQALVVEHIEKMVESVFRNFDVDGDGHISQEEFQIIRGNFPYLSAFGDLDQNQDGCISREEMVSYFLRSSSVLGGRMGFVHNFQESNSLRPVACRHCKALILGIYKQGLKCRACGVNCHKQCKDRLSVECRRRAQSVSLEGSAPSPSPMHSHHHRAFSFSLPRPGRRGSRPPAEIREEEVQTVEDGVFDIHL

SEQ ID NO: 61007 - protein, 609 aa, Homo sapiens; identical to SEQ ID NO: 61005

SEQ ID NO: 61008 - protein, 609 aa, Homo sapiens; identical to SEQ ID NO: 61005

SEQ ID NO: 61009 - protein, 143 aa, Homo sapiens
MAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVCVGEHRGLGGHSVSYTICA

SEQ ID NO: 61010 - protein, 576 aa, Homo sapiens
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITALLELTELLASHNNYARYRRTWAGCAGFRLPVLGVHLKDLVSLHEAQPDRLPDGRLHLPKLNNLYLRLQELVALQGQHPPCSANEDLLHLLTLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 61011 - protein, 617 aa, Homo sapiens
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITPQDLRSYVLQGSVRGCPALEGSVGLSNSVSRWVQVMVLSRPGPLQRAQVLDKFIHVAQRLHQLQNFNTLMAVTGGLCHSAISRLKDSHAHLSPDSTKALLELTELLASHNNYARYRRTWAGCAGFRLPVLGVHLKDLVSLHEAQPDRLPDGRLHLPKLNNLYLRLQELVALQGQHPPCSANEDLLHLLTLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRGEWGVSEWEGSLGPQAGRMDDTDRTPAAAFPQSAGCVATNTAETR

SEQ ID NO: 61012 - protein, 484 aa, Homo sapiens
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 61013 - protein, 581 aa, Homo sapiens
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITPQDLRSYVLQGSVRGCPALEGSVGLSNSVSRWVQVMVLSRPGPLQRAQVLDKFIHVAQRLHQLQNFNTLMAVTGGLCHSAISRLKDSHAHLSPDSTKLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 61014 - protein, 673 aa, Homo sapiens
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITPQDLRSYVLQGSVRGCPALEGSVGLSNSVSRWVQVMVLSRPGPLQRAQVLDKFIHVAQRLHQLQNFNTLMAVTGGLCHSAISRLKDSHAHLSPDSTKALLELTELLASHNNYARYRRTWAGCAGFRLPVLGVHLKDLVSLHEAQPDRLPDGRLHLPKLNNLYLRLQELVALQGQHPPCSANEDLLHLLTLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 61015 - protein, 659 aa, Homo sapiens
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLPGLGKKRKVSLLFDHLETGELAQHLTYLEFRSFQAITPQDLRSYVLQGSVRGCPALEGSVGLSNSVSRWVQVMVLSRPGPLQRAQVLDKFIHVAQRLHQLQNFNTLMAVTGGLCHSAISRLKDSHAHLSPDSTKALLELTELLASHNNYARYRRTWAGCAGFRLPVLGVHLKDLVSLHEAQPDRLPDGRLHLPKLNNLYLRLQELVALQGQHPPCSANEDLLHLLTLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 61016 - protein, 604 aa, Homo sapiens
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITPQDLRSYVLQGSVRGCPALEGSVGLSNSVSRWVQVMVLSRPGPLQRAQVLDKFIHVAQRLHQLQNFNTLMAVTGGLCHSAISRLKDSHAHLSPDSTKELVALQGQHPPCSANEDLLHLLTLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 61017 - protein, 618 aa, Homo sapiens
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHVTQADLKSSTFWLRASFGATVFAVLGFAMYKALLKQR

SEQ ID NO: 61018 - protein, 659 aa, Homo sapiens
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHARLRCMCTCNRCTFCICQNFLNSDLLQSVKNKIFTAVLNRHVTQADLKSSTFWLRASFGATVFAVLGFAMYKALLKQR

SEQ ID NO: 61019 - protein, 691 aa, Homo sapiens
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPEDHYRDRLSRDMGHTDRIENLRKIWVFLKTAFHARLRCMCTCNRCTFCICQNFLNSDLLQSVKNKIFTAVLNRHVTQADLKSSTFWLRASFGATVFAVLGFAMYKALLKQR

SEQ ID NO: 61020 - protein, 650 aa, Homo sapiens
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPEDHYRDRLSRDMGHTDRIENLRKIWVFLKTALHVTQADLKSSTFWLRASFGATVFAVLGFAMYKALLKQR

SEQ ID NO: 61021 - protein, 247 aa, Homo sapiens
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPRFGFEQVLVLLFLQFWALLCTKHY

SEQ ID NO: 61022 - protein, 618 aa, Homo sapiens
MRRDVRILLLGEAQVGKTSLILSLVGEEFPEEVPPRAEEITIPADVTPEKVPTHIVDYSEAEQTDEELREEIHKANVVCVVYDVSEEATIEKIRTKWIPLVNGGTTQGPRVPIILVGNKSDLRSGSSMEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 61023 - protein, 258 aa, Homo sapiens
MPPQQGDPAFPDRCEAPPVPPRRERGGRGGRGPGEPGGRGRAGGAEGRGVKCVLVGDGAVGKTSLVVSYTTNGYPTEYIPTAFDNFSAVVSVDGRPVRLQLCDTAGQDEFDKLRPLCYTNTDIFLLCFSVVSPSSFQNVSEKWVPEIRCHCPKAPIILVGTQSDLREDVKVLIELDKCKEKPVPEEAAKLCAEEIKAASYIECSALTQKNLKEVFDAAIVAGIQYSDTQQQPKKSKSRTPDKMKNLSKSWWKKYCCFV

SEQ ID NO: 61024 - protein, 963 aa, Homo sapiens
MLSGERKEGGSPRFGKLHLPVGLWINSPRKQLAKLGRRWPSAASVKSSSSDTGSRSSEPLPPPPPHVELRRVGAVKAAGGASGSRAKRISQLFRGSGTGTTGSSGAGGPGTPGGAQRWASEKKLPELAAGVAPEPPLATRATAPPGVLKIFGAGLASGANYKSVLATARSTARELVAEALERYGLAGSPGGGPGESSCVDAFALCDALGRPAAAGVGSGEWRAEHLRVLGDSERPLLVQELWRARPGWARRFELRGREEARRLEQEAFGAADSEGTGAPSWRPQKNRSRAASGGAALASPGPGTGSGAPAGSGGKERSENLSLRRSVSELSLQGRRRRQQERRQQALSMAPGAADAQIGTADPGDFDQLTQCLIQAPSNRPYFLLLQGYQDAQDFVVYVMTREQHVFGRGGNSSGRGGSPAPYVDTFLNAPDILPRHCTVRAGPEHPAMVRPSRGAPVTHNGCLLLREAELHPGDLLGLGEHFLFMYKDPRTGGSGPARPPWLPARPGATPPGPGWAFSCRLCGRGLQERGEALAAYLDGREPVLRFRPREEEALLGEIVRAAAAGSGDLPPLGPATLLALCVQHSARELELGHLPRLLGRLARLIKEAVWEKIKEIGDRQPENHPEGVPEVPLTPEAVSVELRPLMLWMANTTELLSFVQEKVLEMEKEADQEDPQLCNDLELCDEAMALLDEVIMCTFQQSVYYLTKTLYSTLPALLDSNPFTAGAELPGPGAELGAMPPGLRPTLGVFQAALELTSQCELHPDLVSQTFGYLFFFSNASLLNSLMERGQGRPFYQWSRAVQIRTNLDLVLDWLQGAGLGDIATEFFRKLSMAVNLLCVPRTSLLKASWSSLRTDHPTLTPAQLHHLLSHYQLGPGRGPPAAWDPPPAEREAVDTGDIFESFSSHPPLILPLGSSRLRLTGPVTDDALHRELRRLRRLLWDLEQQELPANYRHGPPVATSP

SEQ ID NO: 61025 - protein, 849 aa, Homo sapiens
MAAAAPAAAAASSEAPAASATAEPEAGDQDSREVRVLQSLRGKICEAKNLLPYLGPHKMRDCFCTINLDQEEVYRTQVVEKSLSPFFSEEFYFEIPRTFQYLSFYVYDKNVLQRDLRIGKVAIKKEDLCNHSGKETWFSLQPVDSNSEVQGKVHLELKLNELITENGTVCQQLVVHIKACHGLPLINGQSCDPYATVSLVGPSRNDQKKTKVKKKTSNPQFNEIFYFEVTRSSSYTRKSQFQVEEEDIEKLEIRIDLWNNGNLVQDVFLGEIKVPVNVLRTDSSHQAWYLLQPRDNGNKSSKTDDLGSLRLNICYTEDYVLPSEYYGPLKTLLLKSPDVQPISASAAYILSEICRDKNDAVLPLVRLLLHHDKLVPFATAVAELDLKDTQDANTIFRGNSLATRCLDEMMKIVGGHYLKVTLKPILDEICDSSKSCEIDPIKLKEGDNVENNKENLRYYVDKLFNTIVKSSMSCPTVMCDIFYSLRQMATQRFPNDPHVQYSAVSSFVFLRFFAVAVVSPHTFHLRPHHPDAQTIRTLTLISKTIQTLGSWGSLSKSKSSFKETFMCEFFKMFQEEGYIIAVKKFLDEISSTETKESSGTSEPVHLKEGEMYKRAQGRTRIGKKNFKKRWFCLTSRELTYHKQPGKDAIYTIPVKNILAVEKLEESSFNKKNMFQVIHTEKPLYVQANNCVEANEWIDVLCRVSRCNQNRLSFYHPSVYLNGNWLCCQETGENTLGCKPCTAGVPADIQIDIDEDRETERIYSLFTLSLLKLQKMEEACGTIAVYQGPQKEPDDYSNFVIEDSVTTFKTIQQIKSIIEKLDEPHEKYRKKRSSSAKYGSKENPIVGKAS

SEQ ID NO: 61026 - protein, 277 aa, Homo sapiens
MMKIVGGHYLKVTLKPILDEICDSSKSCEIDPIKLKEGDNVENNKENLRYYVDKLFNTIVKSSMSCPTVMCDIFYSLRQMATQRFPNDPHVQYSAVSSFVFLRFFAVAVVSPHTFHLRPHHPDAQTIRTLTLISKTIQTLGSWGSLSKSKSSFKETFMCEFFKMFQEEGYIIAVKKFLDEISSTETKESSGTSEPVHLKEGEMYKRAQGRTRIGKKNFKKRWFCLTSRELTYHKQPGSCVYALLWGFSWFSVKVSLPLIVTLVNPFSNITVVYGFSH

SEQ ID NO: 61027 - protein, 850 aa, Homo sapiens
MAAAAPAAAAASSEAPAASATAEPEAGDQDSREVRVLQSLRGKICEAKNLLPYLGPHKMRDCFCTINLDQEEVYRTQVVEKSLSPFFSEEFYFEIPRTFQYLSFYVYDKNVLQRDLRIGKVAIKKEDLCNHSGKETWFSLQPVDSNSEVQGKVHLELKLNELITENGTVCQQLVVHIKACHGLPLINGQSCDPYATVSLVGPSRNDQKKTKVKKKTSNPQFNEIFYFEVTRSSSYTRKSQFQVEEEDIEKLEIRIDLWNNGNLVQDVFLGEIKVPVNVLRTDSSHQAWYLLQPRDNGNKSSKTDDLGSLRLNICYTEDYVLPSEYYGPLKTLLLKSPDVQPISASAAYILSEICRDKNDAVLPLVRLLLHHDKLVPFATAVAELDLKDTQDANTIFRGNSLATRCLDEMMKIVGGHYLKVTLKPILDEICDSSKSCEIDPIKLKEGDNVENNKENLRYYVDKLFNTIVKSSMSCPTVMCDIFYSLRQMATQRFPNDPHVQYSAVSSFVFLRFFAVAVVSPHTFHLRPHHPDAQTIRTLTLISKTIQTLGSWGSLSKSKSSFKETFMCEFFKMFQEEGYIIAVKKFLDEISSTETKESSGTSEPVHLKEGEMYKRAQGRTRIGKKNFKKRWFCLTSRELTYHKQPGSKDAIYTIPVKNILAVEKLEESSFNKKNMFQVIHTEKPLYVQANNCVEANEWIDVLCRVSRCNQNRLSFYHPSVYLNGNWLCCQETGENTLGCKPCTAGVPADIQIDIDEDRETERIYSLFTLSLLKLQKMEEACGTIAVYQGPQKEPDDYSNFVIEDSVTTFKTIQQIKSIIEKLDEPHEKYRKKRSSSAKYGSKENPIVGKAS

SEQ ID NO: 61028 - protein, 834 aa, Homo sapiens
MAVEDEGLRVFQSVKIKIGEAKNLPSYPGPSKMRDCYCTVNLDQEEVFRTKIVEKSLCPFYGEDFYCEIPRSFRHLSFYIFDRDVFRRDSIIGKVAIQKEDLQKYHNRDTWFQLQHVDADSEVQGKVHLELRLSEVITDTGVVCHKLATRIVECQGLPIVNGQCDPYATVTLAGPFRSEAKKTKVKRKTNNPQFDEVFYFEVTRPCSYSKKSHFDFEEEDVDKLEIRVDLWNASNLKFGDEFLGELRIPLKVLRQSSSYEAWYFLQPRDNGSKSLKPDDLGSLRLNVVYTEDHVFSSDYYSPLRDLLLKSADVEPVSASAAHILGEVCREKQEAAVPLVRLFLHYGRVVPFISAIASAEVKRTQDPNTIFRGNSLASKCIDETMKLAGMHYLHVTLKPAIEEICQSHKPCEIDPVKLKDGENLENNMENLRQYVDRVFHAITESGVSCPTVMCDIFFSLREAAAKRFQDDPDVRYTAVSSFIFLRFFAPAILSPNLFQLTPHHTDPQTSRTLTLISKTVQTLGSLSKSKSASFKESYMATFYEFFNEQKYADAVKNFLDLISSSGRRDPKSVEQPIVLKEGFMIKRAQGRKRFGMKNFKKRWFRLTNHEFTYHKSKGDQPLYSIPIENILAVEKLEEESFKMKNMFQVIQPERALYIQANNCVEAKDWIDILTKVSQCNQKRLTVYHPSAYLSGHWLCCRAPSDSAPGCSPCTGGLPANIQLDIDGDRETERIYSLFNLYMSKLEKMQEACGSKSVYDGPEQEEYSTFVIDDPQETYKTLKQVIAGVGALEQEHAQYKRDKFKKTKYGSQEHPIGDKSFQNYIRQQSETSTHSI

SEQ ID NO: 61029 - protein, 802 aa, Homo sapiens
MRDCYCTVNLDQEEVFRTKIVEKSLCPFYGEDFYCEIPRSFRHLSFYIFDRDVFRRDSIIGKVAIQKEDLQKYHNRDTWFQLQHVDADSEVQGKVHLELRLSEVITDTGVVCHKLATRIVECQGLPIVNGQCDPYATVTLAGPFRSEAKKTKVKRKTNNPQFDEVFYFEVTRPCSYSKKSHFDFEEEDVDKLEIRVDLWNASNLKFGDEFLGELRIPLKVLRQSSSYEAWYFLQPRDNGSKSLKPDDLGSLRLNVVYTEDHVFSSDYYSPLRDLLLKSADVEPVSASAAHILGEVCREKQEAAVPLVRLFLHYGRVVPFISAIASAEVKRTQDPNTIFRGNSLASKCIDETMKLAGMHYLHVTLKPAIEEICQSHKPCEIDPVKLKDGENLENNMENLRQYVDRVFHAITESGVSCPTVMCDIFFSLREAAAKRFQDDPDVRYTAVSSFIFLRFFAPAILSPNLFQLTPHHTDPQTSRTLTLISKTVQTLGSLSKSKSASFKESYMATFYEFFNEQKYADAVKNFLDLISSSGRRDPKSVEQPIVLKEGFMIKRAQGRKRFGMKNFKKRWFRLTNHEFTYHKSKGDQPLYSIPIENILAVEKLEEESFKMKNMFQVIQPERALYIQANNCVEAKDWIDILTKVSQCNQKRLTVYHPSAYLSGHWLCCRAPSDSAPGCSPCTGGLPANIQLDIDGDRETERIYSLFNLYMSKLEKMQEACGSKSVYDGPEQEEYSTFVIDDPQETYKTLKQVIAGVGALEQEHAQYKRDKFKKTKYGSQEHPIGDKSFQNYIRQQSETSTHSI

SEQ ID NO: 61030 - protein, 132 aa, Homo sapiens
MAVEDEGLRVFQSVKIKIGEAKNLPSYPGPSKMRDCYCTVNLDQEEVFRTKIVEKSLCPFYGEDFYCEIPRSFRHLSFYIFDRDVFRRDSIIGQSAPGAAAERGHHRHWGRLPQARHTHRRVPGPPHREWAM

SEQ ID NO: 61031 - protein, 803 aa, Homo sapiens
MAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 61032 - protein, 757 aa, Homo sapiens
MAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 61033 - protein, 731 aa, Homo sapiens
MDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 61034 - protein, 804 aa, Homo sapiens
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 61035 - protein, 776 aa, Homo sapiens
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEAGVPARALFPPSAIVREGYLLKRKEEPAGLATRFAFKKRYVWLSGETLSFSKSPEWQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 61036 - protein, 806 aa, Homo sapiens
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 61037 - protein, 1237 aa, Homo sapiens
MQKSVRYNEGHALYLAFLARKEGTKRGFLSKKTAEASRWHEKWFALYQNVLFYFEGEQSCRPAGMYLLEGCSCERTPAPPRAGAGQGGVRDALDKQYYFTVLFGHEGQKPLELRCEEEQDGKEWMEAIHQASYADILIEREVLMQKYIHLVQIVETEKIAANQLRHQLEDQDTEIERLKSEIIALNKTKERMRPYQSNQEDEDPDIKKIKKVQSFMRGWLCRRKWKTIVQDYICSPHAESMRKRNQIVFTMVEAESEYVHQLYILVNGFLRPLRMAASSKKPPISHDDVSSIFLNSETIMFLHEIFHQGLKARIANWPTLILADLFDILLPMLNIYQEFVRNHQYSLQVLANCKQNRDFDKLLKQYEANPACEGRMLETFLTYPMFQIPRYIITLHELLAHTPHEHVERKSLEFAKSKLEELSRVMHDEVSDTENIRKNLAIERMIVEGCDILLDTSQTFIRQGSLIQVPSVERGKLSKVRLGSLSLKKEGERQCFLFTKHFLICTRSSGGKLHLLKTGGVLSLIDCTLIEEPDASDDDSKGSGQVFGHLDFKIVVEPPDAAAFTVVLLAPSRQEKAAWMSDISQCVDNIRCNGLMTIVFEENSKVTVPHMIKSDARLHKDDTDICFSKTLNSCKVPQIRYASVERLLERLTDLRFLSIDFLNTFLHTYRIFTTAAVVLGKLSDIYKRPFTSIPVRSLELFFATSQNNRGEHLVDGKSPRLCRKFSSPPPLAVSRTSSPVRARKLSLTSPLNSKIGALDLTTSSSPTTTTQSPAASPPPHTGQIPLDLSRGLSSPEQSPGTVEENVDNPRVDLCNKLKRSIQKAVLESAPADRAGVESSPAADTTELSPCRSPSTPRHLRYRQPGGQTADNAHCSVSPASAFAIATAAAGHGSPPGFNNTERTCDKEFIIRRTATNRVLNVLRHWVSKHAQDFELNNELKMNVLNLLEEVLRDPDLLPQERKAAANILRALSQDDQDDIHLKLEDIIQMTDCMKAECFESLSAMELAEQITLLDHVIFRSIPYEEFLGQGWMKLDKNERTPYIMKTSQHFNDMSNLVASQIMNYADVSSRANAIEKWVAVADICRCLHNYNGVLEITSALNRSAIYRLKKTWAKVSKQTKALMDKLQKTVSSEGRFKNLRETLKNCNPPAVPYLGMYLTDLAFIEEGTPNFTEEGLVNFSKMRMISHIIREIRQFQQTSYRIDHQPKVAQYLLDKDLIIDEDTLYELSLKIEPRLPA

SEQ ID NO: 61038 - protein, 1476 aa, Homo sapiens
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKRRRLSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGRGLGGGHKGRKPFECKECSAAFAAKRNCIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTGQKPFPCQKCDAFFSTKSNCERHQLRKHGVTTCSLRRNGLIPQSKESDVGSHDSTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 61039 - protein, 1687 aa, Homo sapiens
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKRRRLSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGRGLGGGHKGRKPFECKECSAAFAAKRNCIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTDSQSDAETAAAAGEVLDLTSRDREQPSEGATELRQVAGDAPVEQATAETASPVHREEHGRGESHEPEEEHGTEESTGDADGAEEDASSNQSLDLDFATKLMDFKLAEGDGEAGAGGAASQEQKLACDTCGKSFKFLGTLSRHRKAHGRQEPKDEKGDGASTAEEGPQPAPEQEEKPPETPAEVVESAPGAGEAPAEKLAEETEGPSDGESAAEKRSSEKSDDDKKPKTDSPKSVASKADKRKKVCSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 61040 - protein, 1687 aa, Homo sapiens; identical to SEQ ID NO: 61039

SEQ ID NO: 61041 - protein, 1742 aa, Homo sapiens
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKRRRLSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGRGLGGGHKGRKPFECKECSAAFAAKRNCIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTGQKPFPCQKCDAFFSTKSNCERHQLRKHGVTTCSLRRNGLIPQSKESDVGSHDSTDSQSDAETAAAAGEVLDLTSRDREQPSEGATELRQVAGDAPVEQATAETASPVHREEHGRGESHEPEEEHGTEESTGDADGAEEDASSNQSLDLDFATKLMDFKLAEGDGEAGAGGAASQEQKLACDTCGKSFKFLGTLSRHRKAHGRQEPKDEKGDGASTAEEGPQPAPEQEEKPPETPAEVVESAPGAGEAPAEKLAEETEGPSDGESAAEKRSSEKSDDDKKPKTDSPKSVASKADKRKKVCSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 61042 - protein, 4 aa, Homo sapiens
MTSS

SEQ ID NO: 61043 - protein, 164 aa, Homo sapiens
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLK

SEQ ID NO: 61044 - protein, 778 aa, Homo sapiens
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKRRRLSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGR

SEQ ID NO: 61045 - protein, 136 aa, Homo sapiens
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTT

SEQ ID NO: 61046 - protein, 62 aa, Homo sapiens
MTSSSPAGLEGSDLSSINTMMSAVMSVGKVTENGGSPQGIKSPSKPPGPNRIGRRNQVSVHT

SEQ ID NO: 61047 - protein, 277 aa, Homo sapiens
MSKSLKKLVEESREKNQPEVDMSDRGISNMLDVNGLFTLSHITQLVLSHNKLTMVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLPPELGNLDLTGQKQVFKAENNPWVTPIADQFQLGVSHVFEYIRSETYKYLYGRHMQANPEPPKKNNDKSKKISRKPLAAKNR

SEQ ID NO: 61048 - protein, 224 aa, Homo sapiens
MVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLPPELGNLDLTGQKQVFKAENNPWVTPIADQFQLGVSHVFEYIRSETYKYLYGRHMQANPEPPKKNNDKSKKISRKPLAAKNR

SEQ ID NO: 61049 - protein, 277 aa, Homo sapiens; identical to SEQ ID NO: 61047

SEQ ID NO: 61050 - protein, 281 aa, Homo sapiens
MKLAAMIKKMCPSDSELSIPAKNCYRMVILGSSKVGKTAIVSRFLTGRFEDAYTPTIEDFHRKFYSIRGEVYQLDILDTSGNHPFPAMRRLSILTGDVFILVFSLDNRDSFEEVQRLRQQILDTKSCLKNKTKENVDVPLVICGNKGDRDFYREVDQREIEQLVGDDPQRCAYFEISAKKNSSLDQMFRALFAMAKLPSEMSPDLHRKVSVQYCDVLHKKALRNKKLLRAGSGGGGGDPGDAFGIVAPFARRPSVHSDLMYIREKASAGSQAKDKERCVIS

SEQ ID NO: 61051 - protein, 266 aa, Homo sapiens
MMKTLSSGNCTLSVPAKNSYRMVVLGASRVGKSSIVSRFLNGRFEDQYTPTIEDFHRKVYNIRGDMYQLDILDTSGNHPFPAMRRLSILTGDVFILVFSLDNRESFDEVKRLQKQILEVKSCLKNKTKEAAELPMVICGNKNDHGELCRQVPTTEAELLVSGDENCAYFEVSAKKNTNVDEMFYVLFSMAKLPHEMSPALHRKISVQYGDAFHPRPFCMRRVKEMDAYGMVSPFARRPSVNSDLKYIKAKVLREGQARERDKCTIQ

SEQ ID NO: 61052 - protein, 199 aa, Homo sapiens
MAKSAEVKLAIFGRAGVGKSALVVRFLTKRFIWEYDPTLESTYRHQATIDDEVVSMEILDTAGQEDTIQREGHMRWGEGFVLVYDITDRGSFEEVLPLKNILDEIKKPKNVTLILVGNKADLDHSRQVSTEEGEKLATELACAFYECSACTGEGNITEIFYELCREVRRRRMVQGKTRRRSSTTHVKQAINKMLTKISS

SEQ ID NO: 61053 - protein, 39 aa, Homo sapiens
MAKSAEVKLAIFGRAGVGKSALVVRFLTKRFIWEYDPTL

SEQ ID NO: 61054 - protein, 199 aa, Homo sapiens; identical to SEQ ID NO: 61052

SEQ ID NO: 61055 - protein, 199 aa, Homo sapiens; identical to SEQ ID NO: 61052

SEQ ID NO: 61056 - protein, 180 aa, Homo sapiens
MAKSAEVKLAIFGRAGVGKSESTYRHQATIDDEVVSMEILDTAGQEDTIQREGHMRWGEGFVLVYDITDRGSFEEVLPLKNILDEIKKPKNVTLILVGNKADLDHSRQVSTEEGEKLATELACAFYECSACTGEGNITEIFYELCREVRRRRMVQGKTRRRSSTTHVKQAINKMLTKISS

SEQ ID NO: 61057 - protein, 203 aa, Homo sapiens
MVSTYRVAVLGARGVGKSAIVRQFLYNEFSEVCVPTTARRLYLPAVVMNGHVHDLQILDFPPISAFPVNTLQEWADTCCRGLRSVHAYILVYDICCFDSFEYVKTIRQQILETRVIGTSETPIIIVGNKRDLQRGRVIPRWNVSHLVRKTWKCGYVECSAKYNWHILLLFSELLKSVGCARCKHVHAALRFQGALRRNRCAIM

SEQ ID NO: 61058 - protein, 242 aa, Homo sapiens
MRPLSMSGHFLLAPIPESSSDYLLPKDIKLAVLGAGRVGKSAMIVRFLTKRFIGDYEPNTGKLYSRLVYVEGDQLSLQIQDTPGGVQIQDSLPQVVDSLSKCVQWAEGFLLVYSITDYDSYLSIRPLYQHIRKVHPDSKAPVIIVGNKGDLLHARQVQTQDGIQLANELGSLFLEISTSENYEDVCDVFQHLCKEVSKMHGLSGERRRASIIPRPRSPNMQDLKRRFKQALSPKVKAPSALG

SEQ ID NO: 61059 - protein, 248 aa, Homo sapiens
MRLIQNMCTIAEYPAPGNAAASDCCVGAAGRRLVKIAVVGASGVGKTALVVRFLTKRFIGDYERNAGNLYTRQVQIEGETLALQVQDTPGIQVHENSLSCSEQLNRCIRWADAVVIVFSITDYKSYELISQLHQHVQQLHLGTRLPVVVVANKADLLHIKQVDPQLGLQLASMLGCSFYEVSVSENYNDVYSAFHVLCKEVSHKQQPSSTPEKRRTSLIPRPKSPNMQDLKRRFKQALSAKVRTVTSV

SEQ ID NO: 61060 - protein, 308 aa, Homo sapiens
MTLNGGGSGAGGSRGGGQERERRRGSTPWGPAPPLHRRSMPVDERDLQAALTPGALTAAAAGTGTQGPRLDWPEDSEDSLSSGGSDSDESVYKVLLLGAPGVGKSALARIFGGVEDGPEAEAAGHTYDRSIVVDGEEASLMVYDIWEQDGGRWLPGHCMAMGDAYVIVYSVTDKGSFEKASELRVQLRRARQTDDVPIILVGNKSDLVRSREVSVDEGRACAVVFDCKFIETSAALHHNVQALFEGVVRQIRLRRDSKEANARRQAGTRRRESLGKKAKRFLGRIVARNSRKMAFRAKSKSCHDLSVL

SEQ ID NO: 61061 - protein, 308 aa, Homo sapiens; identical to SEQ ID NO: 61060

SEQ ID NO: 61062 - protein, 192 aa, Homo sapiens
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPHTPILLVGTKLDLRDDKDTIERLRDKKLAPITYPQGLAMAREIGSVKYLECSALTQRGLKTVFDEAIRAVLCPPPVKKPGKKCTVF

SEQ ID NO: 61063 - protein, 313 aa, Homo sapiens
MPNTAMKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECACFRTSIWDETLYKAWSSIVYQLIPNVQQLEMNLRNFAQIIEADEVLLFERATFLVISHYQCKEQRDVHRFEKISNIIKQFKLSCSKLAASFQSMEVRNSNFAAFIDIFTSNTYVMVVMSDPSIPSAATLINIRNARKHFEKLERVDGPKHSLLMR

SEQ ID NO: 61064 - protein, 374 aa, Homo sapiens
MEESDSEKTTEKENLGPRMDPPLGEPEGSLGWVLPNTAMKKKVLLMGKSGSGKTSMRSIIFANYIARDTRRLGATILDRIHSLQINSSLSTYSLVDSVGNTKTFDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECSCFRTSIWDETLYKAWSSIVYQLIPNVQQLEMNLRNFAEIIEADEVLLFERATFLVISHYQCKEQRDAHRFEKISNIIKQFKLSCSKLAASFQSMEVRNSNFAAFIDIFTSNTYVMVVMSDPSIPSAATLINIRNARKHFEKLERVDGPKQCLLMR

SEQ ID NO: 61065 - protein, 346 aa, Homo sapiens
MEESDSEKTTEKENLGPRMDPPLGEPEGSLGWVLPNTAMKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECSCFRTSIWDETLYKAWSSIVYQLIPNVQQLEMNLRNFAEIIEADEVLLFERATFLVISHYQCKEQRDAHRFEKISNIIKQFKLSCSKLAASFQSMEVRNSNFAAFIDIFTSNTYVMVVMSDPSIPSAATLINIRNARKHFEKLERVDGPKQCLLMR

SEQ ID NO: 61066 - protein, 194 aa, Homo sapiens
MKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECSCFRTSIWDETLYKAWSSIVYQLIPNVQQLEMNLRNFAEIIE

SEQ ID NO: 61067 - protein, 399 aa, Homo sapiens
MSLQYGAEETPLAGSYGAADSFPKDFGYGVEEEEEEAAAAGGGVGAGAGGGCGPGGADSSKPRILLMGLRRSGKSSIQKVVFHKMSPNETLFLESTNKIYKDDISNSSFVNFQIWDFPGQMDFFDPTFDYEMIFRGTGALIYVIDAQDDYMEALTRLHITVSKAYKVNPDMNFEVFIHKVDGLSDDHKIETQRDIHQRANDDLADAGLEKLHLSFYLTSIYDHSIFEAFSKVVQKLIPQLPTLENLLNIFISNSGIEKAFLFDVVSKIYIATDSSPVDMQSYELCCDMIDVVIDVSCIYGLKEDGSGSAYDKESMAIIKLNNTTVLYLKEVTKFLALVCILREESFERKGLIDYNFHCFRKAIHEVFEVGVTSHRSCGHQTSASSLKALTHNGTPRNAI

SEQ ID NO: 61068 - protein, 249 aa, Homo sapiens
MEALARLHLTVTRAYKVNTDINFEVFIHKVDGLSDDHKIETQRDIHQRANDDLADAGLEKIHLSFYLTSIYDHSIFEAFSKVVQKLIPQLPTLENLLNIFISNSGIEKAFLFDVVSKIYIATDSTPVDMQTYELCCDMIDVVIDISCIYGLKEDGAGTPYDKESTAIIKLNNTTVLYLKEVTKFLALVCFVREESFERKGLIDYNFHCFRKAIHEVFEVRMKVVKSRKVQNRLQKKKRATPNGTPRVLL

SEQ ID NO: 61069 - protein, 400 aa, Homo sapiens
MSQVLGKPQPQDEDDAEEEEEEDELVGLADYGDGPDSSDADPDSGTEEGVLDFSDPFSTEVKPRILLMGLRRSGKSSIQKVVFHKMSPNETLFLESTNKICREDVSNSSFVNFQIWDFPGQIDFFDPTFDYEMIFRGTGALIFVIDSQDDYMEALARLHLTVTRAYKVNTDINFEVFIHKVDGLSDDHKIETQRDIHQRANDDLADAGLEKIHLSFYLTSIYDHSIFEAFSKVVQKLIPQLPTLENLLNIFISNSGIEKAFLFDVVSKIYIATDSTPVDMQTYELCCDMIDVVIDISCIYGLKEDGAGTPYDKESTAIIKLNNTTVLYLKEVTKFLALVCFVREESFERKGLIDYNFHCFRKAIHEVFEVRMKVVKSRKVQNRLQKKKRATPNGTPRVLL

SEQ ID NO: 61070 - protein, 115 aa, Homo sapiens
MLRDTMKSWNDSQSDLCSTDQEEEEEMIFGENEDDLDEMMDLSDLPTSLFACSVHEAVFEAREQKERNMNFTREQSRHPAWWFMSVKVKLKRKKRQKTPNRKLPRRGAPTLRPQR

SEQ ID NO: 61071 - protein, 241 aa, Homo sapiens
MLRDTMKSWNDSQSDLCSTDQEEEEEMIFGENEDDLDEMMDLSDLPTSLFACSVHEAVFEAREQKERFEALFTIYDDQVTFQLFKSFRRVRINFSKPEAAARARIELHETDFNGQKLKLYFAQVQMSGEVRDKSYLLPPQPVKQFLISPPASPPVGWKQSEDAMPVINYDLLCAVSKLGPGEKYELHAGTESTPSVVVHVCESETEEEEETKNPKQKIAQTRRPDPPTAALNEPQTFDCAL

SEQ ID NO: 61072 - protein, 173 aa, Homo sapiens
MLRDTMKSWNDSQSDLCSTDQEEEEEMIFGENEDDLDEMMDLSDLPTSLFACSVHEAVFEAREQKERFEALFTIYDDQVTFQLFKSFRRVRINFSKPEAAARARIELHETDFNGQKLKLYFAQERNMNFTREQSRHPAWWFMSVKVKLKRKKRQKTPNRKLPRRGAPTLRPQR

SEQ ID NO: 61073 - protein, 65 aa, Homo sapiens
MLRDTMKSWNDSQSDLCSTDQEEEEEMIFGENEDDLDEMMDLSDLPTSLFACSVHEAVFEAREQK

SEQ ID NO: 61074 - protein, 231 aa, Homo sapiens
MLRDTMKSWNDSQSDLCSTDQEEEEEMIFGENEDDLDEMMDLSDLPTSLFACSVHEAVFEAREQKERFEALFTIYDDQVTFQLFKSFRRVRINFSKPEAAARARIELHETDFNGQKLKLYFAQSYLLPPQPVKQFLISPPASPPVGWKQSEDAMPVINYDLLCAVSKLGPGEKYELHAGTESTPSVVVHVCESETEEEEETKNPKQKIAQTRRPDPPTAALNEPQTFDCAL

SEQ ID NO: 61075 - protein, 183 aa, Homo sapiens
MLRDTMKSWNDSQSDLCSTDQEEEEEMIFGENEDDLDEMMDLSDLPTSLFACSVHEAVFEAREQKVQMSGEVRDKSYLLPPQPVKQFLISPPASPPVGWKQSEDAMPVINYDLLCAVSKLGPGEKYELHAGTESTPSVVVHVCESETEEEEETKNPKQKIAQTRRPDPPTAALNEPQTFDCAL

SEQ ID NO: 61076 - protein, 299 aa, Homo sapiens
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRAREALRQCLPDQLKDTTFAQVLKDDTTTKRWLAQLVKNLQEGQVTDPRGIPLPPQ

SEQ ID NO: 61077 - protein, 331 aa, Homo sapiens
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIVETGFHHVGQADLELPTSSDLPASASQSAGITGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRAREALRQCLPDQLKDTTFAQVLKDDTTTKRWLAQLVKNLQEGQVTDPRGIPLPPQ

SEQ ID NO: 61078 - protein, 299 aa, Homo sapiens; identical to SEQ ID NO: 61076

SEQ ID NO: 61079 - protein, 258 aa, Homo sapiens
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRFSDLTFCWSSFQRK

SEQ ID NO: 61080 - protein, 329 aa, Homo sapiens
MAALGGDGLRLLSVSRPERPPESAALGGLGPGLCCWVSVFSCLSLACSYVGSLYVWKSELPRDHPAVIKRRFTSVLVVSSLSPLCVLLWRELTGIQPGTSLLTLMGFRLEGIFPAALLPLLLTMILFLGPLMQLSMDCPCDLADGLKVVLAPRSWARCLTDMRWLRNQVIAPLTEELVFRACMLPMLAPCMGLGPAVFTCPLFFGVAHFHHIIEQLRFRQSSVGNIFLSAAFQFSYTAVFGAYTAFLFIRTGHLIGPVLCHSFCNYMGFPAVCAALEHPQRRPLLAGYALGVGLFLLLLQPLTDPKLYGSLPLCVLLERAGDSEAPLCS

SEQ ID NO: 61081 - protein, 308 aa, Homo sapiens
MAALGGDGLRLLSVSRPERPPESAALGGLGPGLCCWVSVFSCLSLACSYVGSLYVWKSELPRDHPAVIKRRFTSVLVVSSLSPLCVLLWRELTGIQPGTSLLTLMGFRLEGIFPAALLPLLLTMILFLGPLMQLSMDCPCDLADGLKVVLAPRSWARCLTDMRWLRNQVIAPLTEELVFRACMLPMLAPCMGLGPAVFTCPLFFGVAHFHHIIEQLRFRQSSVGNIFLSAGHLIGPVLCHSFCNYMGFPAVCAALEHPQRRPLLAGYALGVGLFLLLLQPLTDPKLYGSLPLCVLLERAGDSEAPLCS

SEQ ID NO: 61082 - protein, 387 aa, Homo sapiens
MVPKGATMLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 61083 - protein, 380 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 61084 - protein, 380 aa, Homo sapiens; identical to SEQ ID NO: 61083

SEQ ID NO: 61085 - protein, 380 aa, Homo sapiens; identical to SEQ ID NO: 61083

SEQ ID NO: 61086 - protein, 294 aa, Homo sapiens [sequence omitted]

SEQ ID NO: 61087 - protein, 159 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAG

SEQ ID NO: 61088 - protein, 240 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGP

SEQ ID NO: 61089 - protein, 159 aa, Homo sapiens; identical to SEQ ID NO: 61087

SEQ ID NO: 61090 - protein, 159 aa, Homo sapiens; identical to SEQ ID NO: 61087

SEQ ID NO: 61091 - protein, 334 aa, Homo sapiens [sequence omitted]

SEQ ID NO: 61092 - protein, 240 aa, Homo sapiens; identical to SEQ ID NO: 61088

SEQ ID NO: 61093 - protein, 159 aa, Homo sapiens; identical to SEQ ID NO: 61087

SEQ ID NO: 61094 - protein, 334 aa, Homo sapiens [sequence omitted]

SEQ ID NO: 61095 - protein, 159 aa, Homo sapiens; identical to SEQ ID NO: 61087

SEQ ID NO: 61096 - protein, 380 aa, Homo sapiens; identical to SEQ ID NO: 61083

SEQ ID NO: 61097 - protein, 294 aa, Homo sapiens [sequence omitted]

SEQ ID NO: 61098 - protein, 240 aa, Homo sapiens; identical to SEQ ID NO: 61088

SEQ ID NO: 61099 - protein, 294 aa, Homo sapiens [sequence omitted]

SEQ ID NO: 61100 - protein, 334 aa, Homo sapiens [sequence omitted]

SEQ ID NO: 61101 - protein, 334 aa, Homo sapiens [sequence omitted]

SEQ ID NO: 61102 - protein, 334 aa, Homo sapiens [sequence omitted]

SEQ ID NO: 61103 - protein, 350 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 61104 - protein, 380 aa, Homo sapiens; identical to SEQ ID NO: 61083

SEQ ID NO: 61105 - protein, 240 aa, Homo sapiens; identical to SEQ ID NO: 61088

SEQ ID NO: 61106 - protein, 334 aa, Homo sapiens [sequence omitted]

SEQ ID NO: 61107 - protein, 294 aa, Homo sapiens [sequence omitted]

SEQ ID NO: 61108 - protein, 294 aa, Homo sapiens [sequence omitted]

SEQ ID NO: 61109 - protein, 294 aa, Homo sapiens [sequence omitted]

SEQ ID NO: 61110 - protein, 240 aa, Homo sapiens; identical to SEQ ID NO: 61088

SEQ ID NO: 61111 - protein, 380 aa, Homo sapiens; identical to SEQ ID NO: 61083

SEQ ID NO: 61112 - protein, 159 aa, Homo sapiens; identical to SEQ ID NO: 61087

SEQ ID NO: 61113 - protein, 387 aa, Homo sapiens; identical to SEQ ID NO: 61082

SEQ ID NO: 61114 - protein, 387 aa, Homo sapiens; identical to SEQ ID NO: 61082

SEQ ID NO: 61115 - protein, 387 aa, Homo sapiens; identical to SEQ ID NO: 61082

SEQ ID NO: 61116 - protein, 387 aa, Homo sapiens; identical to SEQ ID NO: 61082

SEQ ID NO: 61117 - protein, 387 aa, Homo sapiens; identical to SEQ ID NO: 61082

SEQ ID NO: 61118 - protein, 1097 aa, Homo sapiens
MATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSGEKPFKCDQCSYVASNQHEVTRHARQVHNGPKPLNCPHCDYKTADRSNFKKHVELHVNPRQFNCPVCDYAASKKCNLQYHFKSKHPTCPNKTMDVSKVKLKKTKKREADLPDNITNEKTEIEQTKIKGDVAGKKNEKSVKAEKRDVSKEKKPSNNVSVIQVTTRTRKSVTEVKEMDVHTGSNSEKFSKTKKSKRKLEVDSHSLHGPVNDEESSTKKKKKVESKSKNNSQEVPKGDSKVEENKKQNTCMKKSTKKKTLKNKSSKKSSKPPQKEPVEKGSAQMDPPQMGPAPTEAVQKGPVQVEPPPPMEHAQMEGAQIRPAPDEPVQMEVVQEGPAQKELLPPVEPAQMVGAQIVLAHMELPPPMETAQTEVAQMGPAPMEPAQMEVAQVESAPMQVVQKEPVQMELSPPMEVVQKEPVQIELSPPMEVVQKEPVKIELSPPIEVVQKEPVQMELSPPMGVVQKEPAQREPPPPREPPLHMEPISKKPPLRKDKKEKSNMQSERARKEQVLIEVGLVPVKDSWLLKESVSTEDLSPPSPPLPKENLREEASGDQKLLNTGEGNKEAPLQKVGAEEADESLPGLAANINESTHISSSGQNLNTPEGETLNGKHQTDSIVCEMKMDTDQNTRENLTGINSTVEEPVSPMLPPSAVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 61119 - protein, 1074 aa, Homo sapiens
MATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGKRPSGEKPFKCDQCSYVASNQHEVTRHARQVHNGPKPLNCPHCDYKTADRSNFKKHVELHVNPRQFNCPVCDYAASKKCNLQYHFKSKHPTCPNKTMDVSKVKLKKTKKREADLPDNITNEKTEIEQTKIKGDVAGKKNEKSVKAEKRDVSKEKKPSNNVSVIQVTTRTRKSVTEVKEMDVHTGSNSEKFSKTKKSKRKLEVDSHSLHGPVNDEESSTKKKKKVESKSKNNSQEVPKGDSKVEENKKQNTCMKKSTKKKTLKNKSSKKSSKPPQKEPVEKGSAQMDPPQMGPAPTEAVQKGPVQVEPPPPMEHAQMEGAQIRPAPDEPVQMEVVQEGPAQKELLPPVEPAQMVGAQIVLAHMELPPPMETAQTEVAQMGPAPMEPAQMEVAQVESAPMQVVQKEPVQMELSPPMEVVQKEPVQIELSPPMEVVQKEPVKIELSPPIEVVQKEPVQMELSPPMGVVQKEPAQREPPPPREPPLHMEPISKKPPLRKDKKEKSNMQSERARKEQVLIEVGLVPVKDSWLLKESVSTEDLSPPSPPLPKENLREEASGDQKLLNTGEGNKEAPLQKVGAEEADESLPGLAANINESTHISSSGQNLNTPEGETLNGKHQTDSIVCEMKMDTDQNTRENLTGINSTVEEPVSPMLPPSAVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 61120 - protein, 460 aa, Homo sapiens
MATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSGEKPFKCDQCSYVASNQHEVTRHARQVHNGPKPLNCPHCDYKTADRSNFKKHVELHVNPRQFNCPVCDYAASKKCNLQYHFKSKHPTCPNKTMDVSKVKLKKTKKREADLPDNITNEKTEIEQTKKKKKKKKK

SEQ ID NO: 61121 - protein, 1914 aa, Homo sapiens
MADGKGDAAAVAGAGAEAPAVAGAGDGVETESMVRGHRPVSPAPGASGLRPCLWQLETELREQEVSEVSSLNYCRSFCQTLLQYASNKNASEHIVYLLEVYRLAIQSFASARPYLTTECEDVLLVLGRLVLSCFELLLSVSESELPCEVWLPFLQSLQESHDALLEFGNNNLQILVHVTKEGVWKNPVLLKILSQQPVETEEVNKLIAQEGPSFLQMRIKHLLKSNCIPQATALSKLCAESKEISNVSSFQQAYITCLCSMLPNEDAIKEIAKVDCKEVLDIICNLESEGQDNTAFVLCTTYLTQQLQTASVYCSWELTLFWSKLQRRIDPSLDTFLERCRQFGVIAKTQQHLFCLIRVIQTEAQDAGLGVSILLCVRALQLRSSEDEEMKASVCKTIACLLPEDLEVRRACQLTEFLIEPSLDGFNMLEELYLQPDQKFDEENAPVPNSLRCELLLALKAHWPFDPEFWDWKTLKRHCHQLLGQEASDSDDDLSGYEMSINDTDVLESFLSDYDEGKEDKQYRRRDLTDQHKEKRDKKPIGSSERYQRWLQYKFFCLLCKRECIEARILHHSKMHMEDGIYTCPVCIKKFKRKEMFVPHVMEHVKMPPSRRDRSKKKLLLKGSQKGICPKSPSAIPEQNHSLNDQAKGESHEYVTFSKLEDCHLQDRDLYPCPGTDCSRVFKQFKYLSVHLKAEHQNNDENAKHYLDMKNRREKCTYCRRHFMSAFHLREHEQVHCGPQPYMCVSIDCYARFGSVNELLNHKQKHDDLRYKCELNGCNIVFSDLGQLYHHEAQHFRDASYTCNFLGCKKFYYSKIEYQNHLSMHNVENSNGDIKKSVKLEESATGEKQDCINQPHLLNQTDKSHLPEDLFCAESANSQIDTETAENLKENSDSNSSDQLSHSSSASMNEELIDTLDHSETMQDVLLSNEKVFGPSSLKEKCSSMAVCFDGTKFTCGFDGCGSTYKNARGMQKHLRKVHPYHFKPKKIKTKDLFPSLGNEHNQTTEKLDAEPKPCSDTNSDSPDEGLDHNIHIKCKREHQGYSSESSICASKRPCTEDTMLELLLRLKHLSLKNSITHGSFSGSLQGYPSSGAKSLQSVSSISDLNFQNQDENMPSQYLAQLAAKPFFCELQGCKYEFVTREALLMHYLKKHNYSKEKVLQLTMFQHRYSPFQCHICQRSFTRKTHLRIHYKNKHQIGSDRATHKLLDNEKCDHEGPCSVDRLKGDCSAELGGDPSSNSEKPHCHPKKDECSSETDLESSCEETESKTSDISSPIGSHREEQEGREGRGSRRTVAKGNLCYILNKYHKPFHCIHKTCNSSFTNLKGLIRHYRTVHQYNKEQLCLEKDKARTKRELVKCKKIFACKYKECNKRFLCSKALAKHCSDSHNLDHIEEPKVLSEAGSAARFSCNQPQCPAVFYTFNKLKHHLMEQHNIEGEIHSDYEIHCDLNGCGQIFTHRSNYSQHVYYRHKDYYDDLFRSQKVANERLLRSEKVCQTADTQGHEHQTTRRSFNAKSKKCGLIKEKKAPISFKTRAEALHMCVEHSEHTQYPCMVQGCLSVVKLESSIVRHYKRTHQMSSAYLEQQMENLVVCVKYGTKIKEEPPSEADPCIKKEENRSCESERTEHSHSPGDSSAPIQNTDCCHSSERDGGQKGCIESSSVFDADTLLYRGTLKCNHSSKTTSLEQCNIVQPPPPCKIENSIPNPNGTESGTYFTSFQLPLPRIKESETRQHSSGQENTVKNPTHVPKENFRKHSQPRSFDLKTYKPMGFESSFLKFIQESEEKEDDFDDWEPSEHLTLSNSSQSSNDLTGNVVANNMVNDSEPEVDIPHSSSDSTIHENLTAIPPLIVAETTTVPSLENLRVVLDKALTDCGELALKQLHYLRPVVVLERSKFSTPILDLFPTKKTDELCVGSS

SEQ ID NO: 61122 - protein, 1607 aa, Homo sapiens
MFYHDLFYRELTLFWSKLQRRIDPSLDTFLERCRQFGVIAKTQQHLFCLIRVIQTEAQDAGLGVSILLCVRALQLRSSEDEEMKASVCKTIACLLPEDLEVRRACQLTEFLIEPSLDGFNMLEELYLQPDQKFDEENAPVPNSLRCELLLALKAHWPFDPEFWDWKTLKRHCHQLLGQEASDSDDDLSGYEMSINDTDVLESFLSDYDEGKEDKQYRRRDLTDQHKEKRDKKPIGSSERYQRWLQYKFFCLLCKRECIEARILHHSKMHMEDGIYTCPVCIKKFKRKEMFVPHVMEHVKMPPSRRDRSKKKLLLKGSQKGICPKSPSAIPEQNHSLNDQAKGESHEYVTFSKLEDCHLQDRDLYPCPGTDCSRVFKQFKYLSVHLKAEHQNNDENAKHYLDMKNRREKCTYCRRHFMSAFHLREHEQVHCGPQPYMCVSIDCYARFGSVNELLNHKQKHDDLRYKCELNGCNIVFSDLGQLYHHEAQHFRDASYTCNFLGCKKFYYSKIEYQNHLSMHNVENSNGDIKKSVKLEESATGEKQDCINQPHLLNQTDKSHLPEDLFCAESANSQIDTETAENLKENSDSNSSDQLSHSSSASMNEELIDTLDHSETMQDVLLSNEKVFGPSSLKEKCSSMAVCFDGTKFTCGFDGCGSTYKNARGMQKHLRKVHPYHFKPKKIKTKDLFPSLGNEHNQTTEKLDAEPKPCSDTNSDSPDEGLDHNIHIKCKREHQGYSSESSICASKRPCTEDTMLELLLRLKHLSLKNSITHGSFSGSLQGYPSSGAKSLQSVSSISDLNFQNQDENMPSQYLAQLAAKPFFCELQGCKYEFVTREALLMHYLKKHNYSKEKVLQLTMFQHRYSPFQCHICQRSFTRKTHLRIHYKNKHQIGSDRATHKLLDNEKCDHEGPCSVDRLKGDCSAELGGDPSSNSEKPHCHPKKDECSSETDLESSCEETESKTSDISSPIGSHREEQEGREGRGSRRTVAKGNLCYILNKYHKPFHCIHKTCNSSFTNLKGLIRHYRTVHQYNKEQLCLEKDKARTKRELVKCKKIFACKYKECNKRFLCSKALAKHCSDSHNLDHIEEPKVLSEAGSAARFSCNQPQCPAVFYTFNKLKHHLMEQHNIEGEIHSDYEIHCDLNGCGQIFTHRSNYSQHVYYRHKDYYDDLFRSQKVANERLLRSEKVCQTADTQGHEHQTTRRSFNAKSKKCGLIKEKKAPISFKTRAEALHMCVEHSEHTQYPCMVQGCLSVVKLESSIVRHYKRTHQMSSAYLEQQMENLVVCVKYGTKIKEEPPSEADPCIKKEENRSCESERTEHSHSPGDSSAPIQNTDCCHSSERDGGQKGCIESSSVFDADTLLYRGTLKCNHSSKTTSLEQCNIVQPPPPCKIENSIPNPNGTESGTYFTSFQLPLPRIKESETRQHSSGQENTVKNPTHVPKENFRKHSQPRSFDLKTYKPMGFESSFLKFIQESEEKEDDFDDWEPSEHLTLSNSSQSSNDLTGNVVANNMVNDSEPEVDIPHSSSDSTIHENLTAIPPLIVAETTTVPSLENLRVVLDKALTDCGELALKQLHYLRPVVVLERSKFSTPILDLFPTKKTDELCVGSS

SEQ ID NO: 61123 - protein, 546 aa, Homo sapiens [sequence omitted]

SEQ ID NO: 61124 - protein, 529 aa, Homo sapiens
MFYYPNVLQRHTGCFATIWLAATRGSRLVKREYLRVNVVKTCEEILNYVLVRVQPPQPGLPRPRFSLYLSAQLQIGVIRVYSQQCQYLVEDIQHILERLHRAQLQIRIDMETELPSLLLPNHLAMMETLEDAPDPFFGMMSVDPRLPSPFDIPQIRHLLEAAIPERVEEIPPEVPTEPREPERIPVTVLPPEAITILEAEPIRMLEIEGERELPEVSRRELDLLIAEEEAILLEIPRLPPPAPAEVEGIGEALGPEELRLTGWEPGALLMRRPPVPPPPRRRRRRRLLFWDKETQISPEKFQEQLQTRAHCWECPMVQPPERTIRGPAELFRTPTLSGWLPPELLGLWTHCAQPPPKALRRELPEEAAAEEERRKIEVPSEIEVPREALEPSVPLMVSLEISLEAAEEEKSRISLIPPEERWAWPEVEAPEAPALPVVPELPEVPMEMPLVLPPELELLSLEAVHRAVALELQANREPDFSSLVSPLSPRRMAARVFYLLLVLSAQQILHVKQEKPYGRLLIQPGPRFH

SEQ ID NO: 61125 - protein, 74 aa, Homo sapiens
MFYYPNVLQRHTGCFATIWLAATRGSRLVKREYLRVNVVKTCEEILNYVLVRVQPPQPGLPRPRFSLYLSAQLQ

SEQ ID NO: 61126 - protein, 546 aa, Homo sapiens [sequence omitted]

SEQ ID NO: 61127 - protein, 232 aa, Homo sapiens
MAGDTEVWKQMFQELMREVKPWHRWTLRPDKGLLPNVLKPGWMQYQQWTFARFQCSSCSRNWASAQVLVLFHMNWSEEKSRGQVKMRVFTQRCKKCPQPLFEDPEFTQENISRILKNLVFRILKKCYRGRFQLIEEVPMIKDISLEGPHNSDNCEACLQGFCAGPIQVTSLPPSQTPRVHSIYKVEEVVKPWASGENVYSYACQNHICRNLSIFCCCVILIVIVVIVVKTAI

SEQ ID NO: 61128 - protein, 246 aa, Homo sapiens
MVVDFWTWEQTFQELIQEAKPRATWTLKLDGNLQLDCLAQGWKQYQQRAFGWFRCSSCQRSWASAQVQILCHTYWEHWTSQGQVRMRLFGQRCQKCSWSQYEMPEFSSDSTMRILSNLVQHILKKYYGNGTRKSPEMPVILEVSLEGSHDTANCEACTLGICGQGLKSCMTKPSKSLLPHLKTGNSSPGIGAVYLANQAKNQSAEAKEAKGSGYEKLGPSRDPDPLNICVFILLLVFIVVKCFTSE

SEQ ID NO: 61129 - protein, 148 aa, Homo sapiens
MARALCRLPRRGLWLLLAHHLFMTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 61130 - protein, 126 aa, Homo sapiens
MTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 61131 - protein, 126 aa, Homo sapiens; identical to SEQ ID NO: 61130

SEQ ID NO: 61132 - protein, 126 aa, Homo sapiens; identical to SEQ ID NO: 61130

SEQ ID NO: 61133 - protein, 175 aa, Homo sapiens
MASLRVERAGGPRLPRTRVGRPAALRLLLLLGAVLNPHEALAQPLPTTGTPGSEGGTVKNYETAVQFCWNHYKDQMDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 61134 - protein, 148 aa, Homo sapiens
METGALRRPQLLPLLLLLCGGCPRAGGCNETGMLERLPLCGKAFADMMGKVDVWKWCNLSEFIVYYESFTNCTEMEANVVGCYWPNPLAQGFITGIHRQFFSNCTVDRVHLEDPPDEVLIPLIVIPVVLTVAMAGLVVWRSKRTDTLL

SEQ ID NO: 61135 - protein, 148 aa, Homo sapiens; identical to SEQ ID NO: 61134

SEQ ID NO: 61136 - protein, 151 aa, Homo sapiens
METGALRRPQLLPLLLLLCGGCPRAGGCNETGMLERLPLCGKAFADMMGKVDVWKWCNLSEFIVYYESFTNCTEMEANVVGCYWPNPLAQGFITGIHRQFFSNCTVDRVHLEDPPDEVLIPLIVIPVVLTVAMAGLVVWRSKRTDTLLCGN

SEQ ID NO: 61137 - protein, 201 aa, Homo sapiens
MVSWIISRLVVLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 61138 - protein, 174 aa, Homo sapiens
MDHLQAGGVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 61139 - protein, 208 aa, Homo sapiens
MQKVLSNGQTEEVRSGSRLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 61140 - protein, 180 aa, Homo sapiens
MSLHPCRLNNLPNQVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 61141 - protein, 143 aa, Homo sapiens
MVSWIISRLVVLIFGTLYPAYYSYKAVKSKDIKEYVKWMMYWIIFALFTTAETFTDIFLCWDRVPYRRDCGASACRTSPPSGETAPLLPRAPHHRGLGGPAANTASLRCPGVLLRALAAQAPPRILRSRFRKKSTSSSATETT

SEQ ID NO: 61142 - protein, 252 aa, Homo sapiens
MVSWIISRLVVLIFGTLYPAYSSYKAVKTKNVKEYVKWMMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 61143 - protein, 254 aa, Homo sapiens
MVSWIISRLVVLIFGTLYPAYSSYKAVKTKNVKEYVKWMMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKGQGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 61144 - protein, 240 aa, Homo sapiens [sequence omitted]

SEQ ID NO: 61145 - protein, 255 aa, Homo sapiens
MVSWMISRAVVLVFGMLYPAYYSYKAVKTKNVKEYVRWMMYWIVFALYTVIETVADQTVAWFPLYYELKIAFVIWLLSPYTKGASLIYRKFLHPLLSSKEREIDDYIVQAKERGYETMVNFGRQGLNLAATAAVTAAVKSQGAITERLRSFSMHDLTTIQGDEPVGQRPYQPLPEAKKKSKPAPSESAGYGIPLKDGDEKTDEEAEGPYSDNEMLTHKGLRRSQSMKSVKTTKGRKEVRYGSLKYKVKKRPQVYF

SEQ ID NO: 61146 - protein, 257 aa, Homo sapiens
LMMWLLVERALIQLVFGMLYPAYYSYKAVKTKNVKEYVRWMMYWIVFALYTVIETVADQTVAWFPLYYELKIAFVIWLLSPYTKGASLIYRKFLHPLLSSKEREIDDYIVQAKERGYETMVNFGRQGLNLAATAAVTAAVKSQGAITERLRSFSMHDLTTIQGDEPVGQRPYQPLPEAKKKSKPAPSESAGYGIPLKDGDEKTDEEAEGPYSDNEMLTHKGLRRSQSMKSVKTTKGRKEVRYGSLKYKVKKRPQVYF

SEQ ID NO: 61147 - protein, 257 aa, Homo sapiens
MVSWMICRLVVLVFGMLCPAYASYKAVKTKNIREYVRWMMYWIVFALFMAAEIVTDIFISWFPFYYEIKMAFVLWLLSPYTKGASLLYRKFVHPSLSRHEKEIDAYIVQAKERSYETVLSFGKRGLNIAASAAVQAATKSQGALAGRLRSFSMQDLRSISDAPAPAYHDPLYLEDQVSHRRPPIGYRAGGLQDSDTEDECWSDTEAVPRAPARPREKPLIRSQSLRVVKRKPPVREGTSRSLKVRTRKKTVPSDVDS

SEQ ID NO: 61148 - protein, 173 aa, Homo sapiens
MVSWMICRLVVLVFGMLCPAYASYKAVKTKNIREYVRWMMYWIVFALFMAAEIVTDIFISWFPFYYEIKMAFVLWLLSPYTKGASLLYRKFVHPSLSRHEKEIDAYIVQAKERSYETVLSFGKRGLNIAASAAVQAATKGTGPGACRTATPRMSVGQILRQSPGRQPGPERSP

SEQ ID NO: 61149 - protein, 189 aa, Homo sapiens
MSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKCGFLLWCMAPSPSNGAELLYKRIIRPFFLKHESQMDSVVKDLKDKAKETADAITKEAKKATVNLLGEEKKST

SEQ ID NO: 61150 - protein, 131 aa, Homo sapiens
MSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKVWSGLGFLLPRCLL

SEQ ID NO: 61151 - protein, 184 aa, Homo sapiens
MDGLRQRVEHFLEQRNLVTEVLGALEAKTGVEKRYLAAGAVTLLSLYLLFGYGASLLCNLIGFVYPAYASIKAIESPSKDDDTVWLTYWVVYALFGLAEFFSDLLLSWFPFYYVGKCAFLLFCMAPRPWNGALMLYQRVVRPLFLRHHGAVDRIMNDLSGRALDAAAGITRNVKPSQTPQPKDK

SEQ ID NO: 61152 - protein, 937 aa, Homo sapiens
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWTEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 61153 - protein, 393 aa, Homo sapiens
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACGK

SEQ ID NO: 61154 - protein, 940 aa, Homo sapiens
RARGCSARRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWTEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 61155 - protein, 388 aa, Homo sapiens
MLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 61156 - protein, 943 aa, Homo sapiens
MARGSALPRRPLLCIPAVWAAAALLLSVSRTSGEVEVLDPNDPLGPLDGQDGPIPTLKGYFLNFLEPVNNITIVQGQTAILHCKVAGNPPPNVRWLKNDAPVVQEPRRIIIRKTEYGSRLRIQDLDTTDTGYYQCVATNGMKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRTPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVSNARYVGPKQKAPPFPQPQFIPMKGQIRPMVPPPQLYVPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAEEEEEGSVPETELLGDCDTLQVDEAQVQLEA

SEQ ID NO: 61157 - protein, 412 aa, Homo sapiens
MGQDQTKQQIEKGLQLYQSNQTEKALQVWTKVLEKSSDLMGRFRVLGCLVTAHSEMGRYKEMLKFAVVQIDTARELEDADFLLESYLNLARSNEKLCEFHKTISYCKTCLGLPGTRAGAQLGGQVSLSMGNAFLGLSVFQKALESFEKALRYAHNNDDAMLECRVCCSLGSFYAQVKDYEKALFFPCKAAELVNNYGKGWSLKYRAMSQYHMAVAYRLLGRLGSAMECCEESMKIALQHGDRPLQALCLLCFADIHRSRGDLETAFPRYDSAMSIMTEIGNRLGQVQALLGVAKCWVARKALDKALDAIERAQDLAEEVGNKLSQLKLHCLSESIYRSKGLQRELRAHVVRFHECVEETELYCGLCGESIGEKNSRLQALPCSHIFHLRCLQNNGTRSCPNCRRSSMKPGFV

SEQ ID NO: 61158 - protein, 353 aa, Homo sapiens
MGQDQTKQQIEKGLQLYQSNQTEKALQVWTKVLEKSSDLMGRFRVLGCLVTAHSEMGRYKEMLKFAVVQIDTARELEDADFLLESYLNLARSNEKLCEFHKTISYCKTCLGLPGTRAGAQLGGQVSLSMGNAFLGLSVFQKALESFEKALRYAHNNDDAMLECRVCCSLGSFYAQVKDYEKALFFPCKAAELVNNYGKGWSLKYRAMSQYHMAVAYRLLGRLGSAMECCEESMKIALQHGDRPLQALCLLCFADIHRSRGDLELSQLKLHCLSESIYRSKGLQRELRAHVVRFHECVEETELYCGLCGESIGEKNSRLQALPCSHIFHLRCLQNNGTRSCPNCRRSSMKPGFV

SEQ ID NO: 61159 - protein, 518 aa, Homo sapiens
MSCVKLWPSGAPAPLVSIEELENQELVGKGGFGTVFRAQHRKWGYDVAVKIVNSKAISREVKAMASLDNEFVLRLEGVIEKVNWDQDPKPALVTKFMENGSLSGLLQSQCPRPWPLLCRLLKEVVLGMFYLHDQNPVLLHRDLKPSNVLLDPELHVKLADFGLSTFQGGSQSGTGSGEPGGTLGYLAPELFVNVNRKASTASDVYSFGILMWAVLAGREVELPTEPSLVYEAVCNRQNRPSLAELPQAGPETPGLEGLKELMQLCWSSEPKDRPSFQECLPKTDEVFQMVENNMNAAVSTVKDFLSQLRSSNRRFSIPESGQGGTEMDGFRRTIENQHSRNDVMVSEWLNKLNLEEPPSSVPKKCPSLTKRSRAQEEQVPQAWTAGTSSDSMAQPPQTPETSTFRNQMPSPTSTGTPSPGPRGNQGAERQGMNWSCRTPEPNPVTGRPLVNIYNCSGVQVGDNNYLTMQQTTALPTWGLAPSGKGRGLQHPPPVGSQEGPKDPEAWSRPQGWYNHSGK

SEQ ID NO: 61160 - protein, 401 aa, Homo sapiens
MQRCWQGDPRVRPTFQEITSETEDLCEKPDDEVKETAHDLDVKSPPEPRSEVVPARLKRASAPTFDNDYSLSELLSQLDSGVSQAVEGPEELSRSSSESKLPSSGSGKRLSGVSSVDSAFSSRGSLSLSFEREPSTSDLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWHCTTLAGPPAHRQAAGQAAGGECERPDAGWEDAIAPGRTARALPRGPHPHRPVLRRQRLQPAGTDTPARPRRRGTRALPGCSCIGALARRP

SEQ ID NO: 61161 - protein, 784 aa, Homo sapiens
MEGDGGTPWALALLRTFDAGEFTGWEKVGSGGFGQVYKVRHVHWKTWLAIKCSPSLHVDDRERMELLEEAKKMEMAKFRYILPVYGICREPVGLVMEYMETGSLEKLLASEPLPWDLRFRIIHETAVGMNFLHCMAPPLLHLDLKPANILLDAHYHVKISDFGLAKCNGLSHSHDLSMDGLFGTIAYLPPERIREKSRLFDTKHDVYSFAIVIWGVLTQKKPFADEKNILHIMVKVVKGHRPELPPVCRARPRACSHLIRLMQRCWQGDPRVRPTFQEITSETEDLCEKPDDEVKETAHDLDVKSPPEPRSEVVPARLKRASAPTFDNDYSLSELLSQLDSGVSQAVEGPEELSRSSSESKLPSSGSGKRLSGVSSVDSAFSSRGSLSLSFEREPSTSDLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWLPLHYAAWQGHLPIVKLLAKQPGVSVNAQTLDGRTPLHLAAQRGHYRVARILIDLCSDVNVCSLLAQTPLHVAAETGHTSTARLLLHRGAGKEAMTSDGYTALHLAARNGHLATVKLLVEEKADVLARGPLNQTALHLAAAHGHSEVVEELVSADVIDLFDEQGLSALHLAAQGRHAQTVETLLRHGAHINLQSLKFQGGHGPAATLLRRSKT

SEQ ID NO: 61162 - protein, 832 aa, Homo sapiens
MEGDGGTPWALALLRTFDAGEFTGWEKVGSGGFGQVYKVRHVHWKTWLAIKCSPSLHVDDRERMELLEEAKKMEMAKFRYILPVYGICREPVGLVMEYMETGSLEKLLASEPLPWDLRFRIIHETAVGMNFLHCMAPPLLHLDLKPANILLDAHYHVKISDFGLAKCNGLSHSHDLSMDGLFGTIAYLPPERIREKSRLFDTKHDVYSFAIVIWGVLTQKKPFADEKNILHIMVKVVKGHRPELPPVCRARPRACSHLIRLMQRCWQGDPRVRPTFQGNGLNGELIRQVLAALLPVTGRWRSPGEGFRLESEVIIRVTCPLSSPQEITSETEDLCEKPDDEVKETAHDLDVKSPPEPRSEVVPARLKRASAPTFDNDYSLSELLSQLDSGVSQAVEGPEELSRSSSESKLPSSGSGKRLSGVSSVDSAFSSRGSLSLSFEREPSTSDLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWLPLHYAAWQGHLPIVKLLAKQPGVSVNAQTLDGRTPLHLAAQRGHYRVARILIDLCSDVNVCSLLAQTPLHVAAETGHTSTARLLLHRGAGKEAMTSDGYTALHLAARNGHLATVKLLVEEKADVLARGPLNQTALHLAAAHGHSEVVEELVSADVIDLFDEQGLSALHLAAQGRHAQTVETLLRHGAHINLQSLKFQGGHGPAATLLRRSKT

SEQ ID NO: 61163 - protein, 721 aa, Homo sapiens
MELLEEAKKMEMAKFRYILPVYGICREPVGLVMEYMETGSLEKLLASEPLPWDLRFRIIHETAVGMNFLHCMAPPLLHLDLKPANILLDAHYHVKISDFGLAKCNGLSHSHDLSMDGLFGTIAYLPPERIREKSRLFDTKHDVYSFAIVIWGVLTQKKPFADEKNILHIMVKVVKGHRPELPPVCRARPRACSHLIRLMQRCWQGDPRVRPTFQEITSETEDLCEKPDDEVKETAHDLDVKSPPEPRSEVVPARLKRASAPTFDNDYSLSELLSQLDSGVSQAVEGPEELSRSSSESKLPSSGSGKRLSGVSSVDSAFSSRGSLSLSFEREPSTSDLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWLPLHYAAWQGHLPIVKLLAKQPGVSVNAQTLDGRTPLHLAAQRGHYRVARILIDLCSDVNVCSLLAQTPLHVAAETGHTSTARLLLHRGAGKEAMTSDGYTALHLAARNGHLATVKLLVEEKADVLARGPLNQTALHLAAAHGHSEVVEELVSADVIDLFDEQGLSALHLAAQGRHAQTVETLLRHGAHINLQSLKFQGGHGPAATLLRRSKT

SEQ ID NO: 61164 - protein, 721 aa, Homo sapiens; identical to SEQ ID NO: 61163

SEQ ID NO: 61165 - protein, 1043 aa, Homo sapiens
MAASFPPTLGLSSAPDEIQHPHIKFSEWKFKLFRVRSFEKTPEEAQKEKKDSFEGKPSLEQSPAVLDKADGQKPVPTQPLLKAHPKFSKKFHDNEKARGKAIHQANLRHLCRICGNSFRADEHNRRYPVHGPVDGKTLGLLRKKEKRATSWPDLIAKVFRIDVKADVDSIHPTEFCHNCWSIMHRKFSSAPCEVYFPRNVTMEWHPHTPSCDICNTARRGLKRKSLQPNLQLSKKLKTVLDQARQARQHKRRAQARISSKDVMKKIANCSKIHLSTKLLAVDFPEHFVKSISCQICEHILADPVETNCKHVFCRVCILRCLKVMGSYCPSCRYPCFPTDLESPVKSFLSVLNSLMVKCPAKECNEEVSLEKYNHHISSHKESKEIFVHINKGGRPRQHLLSLTRRAQKHRLRELKLQVKAFADKEEGGDVKSVCMTLFLLALRARNEHRQADELEAIMQGKGSGLQPAVCLAIRVNTFLSCSQYHKMYRTVKAITGRQIFQPLHALRNAEKVLLPGYHHFEWQPPLKNVSSSTDVGIIDGLSGLSSSVDDYPVDTIAKRFRYDSALVSALMDMEEDILEGMRSQDLDDYLNGPFTVVVKESCDGMGDVSEKHGSGPVVPEKAVRFSFTIMKITIAHSSQNVKVFEEAKPNSELCCKPLCLMLADESDHETLTAILSPLIAEREAMKSSELMLELGGILRTFKFIFRGTGYDEKLVREVEGLEASGSVYICTLCDATRLEASQNLVFHSITRSHAENLERYEVWRSNPYHESVEELRDRVKGVSAKPFIETVPSIDALHCDIGNAAEFYKIFQLEIGEVYKNPNASKEERKRWQATLDKHLRKKMNLKPIMRMNGNFARKLMTKETVDAVCELIPSEERHEALRELMDLYLKMKPVWRSSCPAKECPESLCQYSFNSQRFAELLSTKFKYRYEGKITNYFHKTLAHVPEIIERDGSIGAWASEGNESGNKLFRRFRKMNARQSKCYEMEDVLKHHWLYTSKYLQKFMNAHNALKTSGFTMNPQASLGDPLGIEDSLESQDSMEF

SEQ ID NO: 61166 - protein, 527 aa, Homo sapiens
MSLQMVTVSNNIALIQPGFSLMNFDGQVFFFGQKGWPKRSCPTGVFHLDVKHNHVKLKPTIFSKDSCYLPPLRYPATCTFKGSLESEKHQYIIHGGKTPNNEVSDKIYVMSIVCKNNKKVTFRCTEKDLVGDVPEARYGHSINVVYSRGKSMGVLFGGRSYMPSTHRTTEKWNSVADCLPCVFLVDFEFGCATSYILPELQDGLSFHVSIAKNDTIYILGGHSLANNIRPANLYRIRVDLPLGSPAVNCTVLPGGISVSSAILTQTNNDEFVIVGGYQLENQKRMICNIISLEDNKIEIREMETPDWTPDIKHSKIWFGSNMGNGTVFLGIPGDNKQVVSEGFYFYMLKCAEDDTNEEQTTFTNSQTSTEDPGDSTPFEDSEEFCFSAEANSFDGDDEFDTYNEDDEEDESETGYWITCCPTCDVDINTWVPFYSTELNKPAMIYCSHGDGHWVHAQCMDLAERTLIHLSAGSNKYYCNEHVEIARALHTPQRVLPLKKPPMKSLRKKGSGKILTPAKKSFLRRLFD

SEQ ID NO: 61167 - protein, 71 aa, Homo sapiens
MSLQMVTVSNNIALIQPGFSLMNFDGQVFFFGQKGWPKRSCPTGVFHLDVKHNHVKLKPTIFSKDSCYLPP

SEQ ID NO: 61168 - protein, 150 aa, Homo sapiens
MSLQMVTVSNNIALIQPGFSLMNFDGQVFFFGQKGWPKRSCPTGVFHLDVKHNHVKLKPTIFSKDSCYLPPLRYPATCTFKGSLESEKHQYIIHGGKTPNNEVSDKIYVMSIVCKNNKKVTFRCTEKDLVGDVPEARYGHSINVVYSRGK

SEQ ID NO: 61169 - protein, 1 aa, Homo sapiens
M

SEQ ID NO: 61170 - protein, 500 aa, Homo sapiens
MDHTEGSPAEEPPAHAPSPGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 61171 - protein, 486 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 61172 - protein, 485 aa, Homo sapiens
MGGCRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 61173 - protein, 487 aa, Homo sapiens
MAPVVTGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 61174 - protein, 486 aa, Homo sapiens; identical to SEQ ID NO: 61171

SEQ ID NO: 61175 - protein, 500 aa, Homo sapiens; identical to SEQ ID NO: 61170

SEQ ID NO: 61176 - protein, 143 aa, Homo sapiens
MRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNAD

SEQ ID NO: 61177 - protein, 28 aa, Homo sapiens
MAWIKRKFGERPPPKRLTREAMRNYLKE

SEQ ID NO: 61178 - protein, 97 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQE

SEQ ID NO: 61179 - protein, 465 aa, Homo sapiens
MRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 61180 - protein, 157 aa, Homo sapiens
MRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNR

SEQ ID NO: 61181 - protein, 49 aa, Homo sapiens
MAWIKRKFGERPPPKRLTREAMRNYLKERGDQTVLILHAKVAQKSYGNE

SEQ ID NO: 61182 - protein, 107 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKN

SEQ ID NO: 61183 - protein, 94 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNS

SEQ ID NO: 61184 - protein, 178 aa, Homo sapiens
MDHTEGSPAEEPPAHAPSPGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNAD

SEQ ID NO: 61185 - protein, 110 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCT

SEQ ID NO: 61186 - protein, 113 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKT

SEQ ID NO: 61187 - protein, 48 aa, Homo sapiens
MAWIKRKFGERPPPKRLTREAMRNYLKERGDQTVLILHAKVAQKSYGN

SEQ ID NO: 61188 - protein, 189 aa, Homo sapiens
MRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHL

SEQ ID NO: 61189 - protein, 199 aa, Homo sapiens
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAGKEVFLVMPTGGGKSLCYQLPALCSDGFTLVICPLISLMEDQLMVLKQLGISATMLNASSSKEHVKWVHAEMVNKNSELKLIYVTPEKIAKSKM

SEQ ID NO: 61190 - protein, 211 aa, Homo sapiens
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAGKEVFLVMPTGGGKSLCYQLPALCSDGFTLVICPLISLMEDQLMVLKQLGISATMLNASSSKEHVKWVHAEMVNKNSELKLIYVTPEKIAKSKMFMSRLEKAYEAR

SEQ ID NO: 61191 - protein, 649 aa, Homo sapiens
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAGKEVFLVMPTGGGKSLCYQLPALCSDGFTLVICPLISLMEDQLMVLKQLGISATMLNASSSKEHVKWVHAEMVNKNSELKLIYVTPEKIAKSKMFMSRLEKAYEARRFTRIAVDEVHCCSQWGHDFRPDYKALGILKRQFPNASLIGLTATATNHVLTDAQKILCIEKCFTFTASFNRPNLYYEVRQKPSNTEDFIEDIVKLINGRYKGQSGIIYCFSQKDSEQVTVSLQNLGIHAGAYHANLEPEDKTTVHRKWSANEIQVVVATVAFGMGIDKPDVRFVIHHSMSKSMENYYQESGRAGRDDMKADCILYYGFGDIFRISSMVVMENVGQQKLYEMVSYCQNISKCRRVLMAQHFDEVWNSEACNKMCDNCCKDSAFERKNITEYCRDLIKILKQAEELNEKLTPLKLIDSWMGKGAAKLRVAGVVAPTLPREDLEKIIAHFLIQQYLKEDYSFTAYATISYLKIGPKANLLNNEAHAITMQVTKSTQNSFRAESSQTCHSEQGDKKMEEKNSGNFQKKAANMLQQSGSKNTGAKKRKIDDA

SEQ ID NO: 61192 - protein, 649 aa, Homo sapiens; identical to SEQ ID NO: 61191

SEQ ID NO: 61193 - protein, 106 aa, Homo sapiens
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAG

SEQ ID NO: 61194 - protein, 97 aa, Homo sapiens
MASVSALTEELDSITSELHAVEIQIQELTERQQELIQKKKVLTKKIKQCLEDSDAGASNEYDSSPAAWNKEDFPWSGKVKDILQNVFKLEKFRPLQL

SEQ ID NO: 61195 - protein, 72 aa, Homo sapiens
MASVSALTEELDSITSELHAVEIQIQELTERQQELIQKKKVLTKKIKQCLEDSDAGASNEYDSSPAAWNKED

SEQ ID NO: 61196 - protein, 131 aa, Homo sapiens
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAGKEVFLVMPTGGGKSLCYQLPALCSD

SEQ ID NO: 61197 - protein, 991 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 61198 - protein, 435 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGRWGRGHGKSLRAAWCSQVVSRHAEL

SEQ ID NO: 61199 - protein, 410 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELG

SEQ ID NO: 61200 - protein, 1018 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESGPHGWVFWDTCRGQKVEGGGAAAGRRGRKSGPSPSSKSG

SEQ ID NO: 61201 - protein, 586 aa, Homo sapiens
MFLVRCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 61202 - protein, 166 aa, Homo sapiens
MAQTSSYFMLISCLMFLSQSQGQEAQTELPQARISCPEGTNAYRSYCYYFNEDRETWVDADLYCQNMNSGNLVSVLTQAEGAFVASLIKESGTDDFNVWIGLHDPKKNRRWHWSSGSLVSYKSWGIGAPSSVNPGYCVSLTSSTGFQKWKDVPCEDKFSFVCKFKN

SEQ ID NO: 61203 - protein, 175 aa, Homo sapiens
MLPPMALPSVSWMLLSCLILLCQVQGEETQKELPSPRISCPKGSKAYGSPCYALFLSPKSWMDADLACQKRPSGKLVSVLSGAEGSFVSSLVRSISNSYSYIWIGLHDPTQGSEPDGDGWEWSSTDVMNYFAWEKNPSTILNPGHCGSLSRSTGFLKWKDYNCDAKLPYVCKFKD

SEQ ID NO: 61204 - protein, 175 aa, Homo sapiens; identical to SEQ ID NO: 61203

SEQ ID NO: 61205 - protein, 129 aa, Homo sapiens
MLPPMALPSVSWMLLSCLILLCQVQGEETQKELPSPRISCPKGSKAYGSPCYALFLSPKSWMDADGSEPDGDGWEWSSTDVMNYFAWEKNPSTILNPGHCGSLSRSTGFLKWKDYNCDAKLPYVCKFKD

SEQ ID NO: 61206 - protein, 158 aa, Homo sapiens
MASRSMRLLLLLSCLAKTGVLGDIIMRPSCAPGWFYHKSNCYGYFRKLRNWSDAELECQSYGNGAHLASILSLKEASTIAEYISGYQRSQPIWIGLHDPQKRQQWQWIDGAMYLYRSWSGKSMGGNKHCAEMSSNNNFLTWSSNECNKRQHFLCKYRP

SEQ ID NO: 61207 - protein, 158 aa, Homo sapiens; identical to SEQ ID NO: 61206

SEQ ID NO: 61208 - protein, 134 aa, Homo sapiens
MASRSMRLLLLLSCLAKTGVLGDIIMRPSCAPGWFYHKSNCYGYFRKLRNWSDAEVRNLLPAWPGLSRAKDQPEPQISFDSGSSVLPGHYEEKPLWLVKWREEGCVFNSFNSVSIAEAGAVCQTLDGLQAHTDT

SEQ ID NO: 61209 - protein, 124 aa, Homo sapiens
MASRSMRLLLLLSCLAKTGVLGDIIMRPSCAPGWFYHKSNCYGYFRKLRNWSDAELECQSYGNGAHLASILSLKEASTIAEYISGYQRSQPIWIGLHDPQKQPLNSCLFFLWPWEGLPVESLLG

SEQ ID NO: 61210 - protein, 299 aa, Homo sapiens
MSSIKIECVLPENCRCGESPVWEEVSNSLLFVDIPAKKVCRWDSFTKQVQRVTMDAPVSSVALRQSGGYVATIGTKFCALNWKEQSAVVLATVDNDKKNNRFNDGKVDPAGRYFAGTMAEETAPAVLERHQGALYSLFPDHHVKKYFDQVDISNGLDWSLDHKIFYYIDSLSYSVDAFDYDLQTGQISNRRSVYKLEKEEQIPDGMCIDAEGKLWVACYNGGRVIRLDPVTGKRLQTVKLPVDKTTSCCFGGKNYSEMYVTCARDGMDPEGLLRQPEAGGIFKITGLGVKGIAPYSYAG

SEQ ID NO: 61211 - protein, 299 aa, Homo sapiens; identical to SEQ ID NO: 61210

SEQ ID NO: 61212 - protein, 299 aa, Homo sapiens; identical to SEQ ID NO: 61210

SEQ ID NO: 61213 - protein, 227 aa, Homo sapiens
MSSIKIECVLPENCRCGESPVWEEVSNSLLFVDIPAKKVCRWDSFTKQVQRVTMDAPVSSVALRQSGGYVATIGTKFCALNWKEQSAVVLATVDNDKKNNRFNDGKVDPAGRYFAANRRSVYKLEKEEQIPDGMCIDAEGKLWVACYNGGRVIRLDPVTGKRLQTVKLPVDKTTSCCFGGKNYSEMYVTCARDGMDPEGLLRQPEAGGIFKITGLGVKGIAPYSYAG

SEQ ID NO: 61214 - protein, 1291 aa, Homo sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKYVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDRMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61215 - protein, 1475 aa, Homo sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDICVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRIRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61216 - protein, 1371 aa, Homo sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNENKIVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERGRWSPSLDRRRPPSPRIQIQHASPENDRMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61217 - protein, 1541 aa, Homo sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKYVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHLVRHYKTLPPKMPLLQSSSHWNIYSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61218 - protein, 1481 aa, Homo sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNENKIVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61219 - protein, 1481 aa, Homo sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61220 - protein, 1692 aa, Homo sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHLVRHYKTLPPKMPLLQSSSHWNIYSSILPAHTKTKSVTRQDISLHHECFNSTVLRFTDEILVSELQPFLDRARSASTNCLRPDTSLHSPERERGRWSPSLDRRRPPSPRIQIQHASPENDRHSRKSERSSIQKQTRKGTASDAERVLPTCLSRRGHAAPRATDQPVIRGKHPARSRSSEHSSIRTLCSMHHLVPGGSAPPSPLLTRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61221 - protein, 498 aa, Homo sapiens
MLPRAKRGRSAECLHTTRHSRKSERSSIQKQTRKGTASDAERMHRQRSPTQSPPADTSFSSRRGRQLPQVPVRSGSIEQEQEKYNSSTKASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61222 - protein, 1012 aa, Homo sapiens
MCAPGIHVSSEGWEEVRSVDSEEGTIEARRAVAGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERHSRKSERSSIQKQTRKGTASDAERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61223 - protein, 219 aa, Homo sapiens
MAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61224 - protein, 760 aa, Homo sapiens
MPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERHSRKSERSSIQKQTRKGTASDAERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61225 - protein, 826 aa, Homo sapiens
MFAGFLQFLLLHTLHSGTGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERHSRKSERSSIQKQTRKGTASDAERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61226 - protein, 817 aa, Homo sapiens
MCAPGIHVSSEGWEEVRSVDSEEGTIEARRAVAGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 61227 - protein, 1188 aa, Homo sapiens
MQFETLRQVCNSVLSHFHGVFSSPPNILQNELFGQTLNNARKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDSQKGKRKTSEQAVLSDSNTRSERQKEMMYFGGHSLEEDLEWSEPQIKDSGVDTCSSTTLNEEHSHSDKHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDRKAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 61228 - protein, 1386 aa, Homo sapiens
MSAPVGPRGRLAPIPAASQPPLQPEMPDLSHLTEEERKIILAVMDRQKKEVKEEHKPQLTQWFPFSGITELVNNVLQPQQKQQNEKEPQTKLHQQFEMYKEQVKKMGEESQQQQEQKGDAPTCGICHKTKFADGCGHNCSYCQTKFCARCGGRVSLRSNKVMWVCNLCRKQQEILTKSGAWFYNSGSNTPQQPDQKVLRGLRNEEAPQEKKPKLHEQTQFQGPSGDLSVPAVEKSRSHGLTRQHSIKNGSGVKHHIASDIASDRKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDMDYNWLDHTSWHSSEASPMSLHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDSHFLTLPRSRYSQTIDHHHRDGRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDRKAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 61229 - protein, 285 aa, Homo sapiens
MGRQGLGGASAAGRSMQRSQSRSSLSASFEALAGYFPCMNSLEEEEGEAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 61230 - protein, 127 aa, Homo sapiens [sequence omitted]

SEQ ID NO: 61231 - protein, 1411 aa, Homo sapiens
MSAPVGPRGRLAPIPAASQPPLQPEMPDLSHLTEEERKIILAVMDRQKKEVKEEHKPQLTQWFPFSGITELVNNVLQPQQKQQNEKEPQTKLHQQFEMYKEQVKKMGEESQQQQEQKGDAPTCGICHKTKFADGCGHNCSYCQTKFCARCGGRVSLRSNKVMWVCNLCRKQQEILTKSGAWFYNSGSNTPQQPDQKVLRGLRNEEAPQEKKPKLHEQTQFQGPSGDLSVPAVEKSRSHGLTRQHSIKNGSGVKHHIASDIASDRKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDSQKGKRKTSEQAVLSDSNTRSERQKEMMYFGGHSLEEDLEWSEPQIKDSGVDTCSSTTLNEEHSHSDKHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDRKAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 61232 - protein, 1349 aa, Homo sapiens
MSAPVGPRGRLAPIPAASQPPLQPEMPDLSHLTEEERKIILAVMDRQKKEEEKEQSVLKKLHQQFEMYKEQVKKMGEESQQQQEQKGDAPTCGICHKTKFADGCGHNCSYCQTKFCARCGGRVSLRSNKVMWVCNLCRKQQEILTKSGAWFYNSGSNTPQQPDQKVLRGLRNEEAPQEKKPKLHEQTQFQGPSGDLSVPAVEKSRSHGLTRQHSIKNGSGVKHHIASDIASDRKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDMDYNWLDHTSWHSSEASPMSLHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSSQSLSRRTTPFVPRVQIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDRKAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 61233 - protein, 1163 aa, Homo sapiens
MQFETLRQVCNSVLSHFHGVFSSPPNILQNELFGQTLNNARKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDMDYNWLDHTSWHSSEASPMSLHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDSHFLTLPRSRYSQTIDHHHRDGRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDRKAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 61234 - protein, 308 aa, Homo sapiens
MFNGEPGPASSGASRNVVRSSSISGEICGSQQAGGGAGTTTAKKRRSSLGAKMVAIVGLTQWSKSTLQLPQPEGATKKLRSNIRRSTETGIAVEMRSRVTRQGSRESTDGSTNSNSSDGTFIFPTTRLGAESQFSDFLDGLGPAQIVGRQTLATPPMGDVHIAIMDRSGQLEVEVIEARGLTPKPGSKSLPATYIKVYLLENGACLAKKKTKMTKKTCDPLYQQALLFDEGPQGKVLQVIVWGDYGRMDHKCFMGMAQIMLDELDLSAAVTGWYKLFPTSSVADSTLGSLTRRLSQSSLESATSPSCS

SEQ ID NO: 61235 - protein, 308 aa, Homo sapiens; identical to SEQ ID NO: 61234

SEQ ID NO: 61236 - protein, 269 aa, Homo sapiens
MERSQSRLSLSASFEALAIYFPCMNSFDDEDAGDSRRLKGAIQRSTETGLAVEMPSRTLRQASHESIEDSMNSYGSEGNLNYGGVCLASDAQFSDFLGSMGPAQFVGRQTLATTPMGDVEIGLQERNGQLEVDIIQARGLTAKPGSKTLPAAYIKAYLLENGICIAKKKTKVARKSLDPLYNQVLLFPESPQGKVLQVIVWGNYGRMERKQFMGVARVLLEELDLTTLAVGWYKLFPTSSMVDPATGPLLRQASQLSLESTVGPCGERS

SEQ ID NO: 61237 - protein, 270 aa, Homo sapiens
MERSQSRLSLSASFEALAIYFPCMNSFDDEDAEGDSRRLKGAIQRSTETGLAVEMPSRTLRQASHESIEDSMNSYGSEGNLNYGGVCLASDAQFSDFLGSMGPAQFVGRQTLATTPMGDVEIGLQERNGQLEVDIIQARGLTAKPGSKTLPAAYIKAYLLENGICIAKKKTKVARKSLDPLYNQVLLFPESPQGKVLQVIVWGNYGRMERKQFMGVARVLLEELDLTTLAVGWYKLFPTSSMVDPATGPLLRQASQLSLESTVGPCGERS

SEQ ID NO: 61238 - protein, 252 aa, Homo sapiens
MEDGVAGPQLGAAAEAAEAAEARARPGVTLRPFAPLSGAAEADEGGGDWSFIDCEMEEVDLQDLPSATIACHLDPRVFVDGLCRAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 61239 - protein, 197 aa, Homo sapiens
MHFRNFNYSFSSLIACVANSDIFSESETRAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 61240 - protein, 242 aa, Homo sapiens
MQGEQGRRLFRLLLNDLPGRDRLPCSYPQPHVEQASTSASPRLLAVNIPEDTLLSYPESSLPLQRHCAFHRFSKAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 61241 - protein, 117 aa, Homo sapiens
MKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 61242 - protein, 117 aa, Homo sapiens; identical to SEQ ID NO: 61241

SEQ ID NO: 61243 - protein, 117 aa, Homo sapiens; identical to SEQ ID NO: 61241

SEQ ID NO: 61244 - protein, 243 aa, Homo sapiens
MRGESYFIGMRSPGQQGHVPEDGGLFLLCCIDRDWAVTRCFAEEAFQAITDFNDLPNSLFACNVHQSVFEGEESKEKFEGLFRTYDDCVTFQLFKSFRRVRINFSNPKSAARARIELHETQFRGKKLKLYFAQVQTPETDGDKLHLAPPQPAKQFLISPPSSPPVGWQPINDATPVLNYDLLYAVAKLGPGEKYELHAGTESTPSVVVHVCDSDIEEEEDPKTSPKPKIIQTRRPGLPPSVSN

SEQ ID NO: 61245 - protein, 197 aa, Homo sapiens [sequence omitted]

SEQ ID NO: 61246 - protein, 243 aa, Homo sapiens; identical to SEQ ID NO: 61244

SEQ ID NO: 61247 - protein, 243 aa, Homo sapiens; identical to SEQ ID NO: 61244

SEQ ID NO: 61248 - protein, 531 aa, Homo sapiens
MVDVGKWPIFTLLSPQEIASIRKACVFGTSASEALYVTDNDEVFVFGLNYSNCLGTGDNQSTLVPKKLEGLCGKKIKSLSYGSGPHVLLSTEDGVVYAWGHNGYSQLGNGTTNQGIAPVQVCTNLLIKQVVEVACGSHHSMALAADGEVFAWGYNNCGQVGSGSTANQPTPRKVTNCLHIKRVVGIACGQTSSMAVLDNGEVYGWGYNGNGQLGLGNNGNQLTPVRVAALHSVCVNQIVCGYAHTLALTDEGLLYAWGANTYGQLGTGNKNNLLSPAHIMVEKERVVEIAACHSAHTSAAKTQGGHVYMWGQCRGQSVILPHLTHFSCTDDVFACFATPAVSWRLLSVEHEDFLTVAESLKKEFDSPETADLKFRIDGKYIHVHKAVLKIRCEHFRSMFQSYWNEDMKEVIEIDQFSYPVYRAFLQYLYTDTVDLPPEDAIGLLDLATSYCENRLKKLCQHIIKRGITVENAFSLFSAAVRYDAEDLEEFCFKFCINHLTEVTQTAAFWQMDGPLLKEFIAKASKCGAFKN

SEQ ID NO: 61249 - protein, 531 aa, Homo sapiens; identical to SEQ ID NO: 61248

SEQ ID NO: 61250 - protein, 355 aa, Homo sapiens
MVDVGKWPIFTLLSPQEIASIRKACVFGTSASEALYVTDNDEVFVFGLNYSNCLGTGDNQSTLVPKKLEGLCGKKIKSLSYGSGPHVLLSTEDGVVYAWGHNGYSQLGNGTTNQGIAPVQVCTNLLIKQVVEVACGSHHSMALAADGEVFAWGYNNCGQVGSGSTANQPTPRKVTNCLHIKRVVGIACGQTSSMAVLDNGEVYGWGYNGNGQLGLGNNGNQLTPVRVAALHSVCVNQIVCGYAHTLALTDEGLLYAWGANTYGQLGTGNKNNLLSPAHIMVEKERVVEIAACHSAHTSAAKTQGGHVYMWGQCRGQSVILPHLTHFSCTDDVFACFATPAVSWRLLSVVSIVIGK

SEQ ID NO: 61251 - protein, 551 aa, Homo sapiens
MEEELPLFSGDSGKPVQATLSSLKMLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYAHTLVLTDEGQVYAWGANSYGQLGTGNKSNQSYPTPVTVEKDRIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 61252 - protein, 556 aa, Homo sapiens
MSALPRDLELSNPREKLTKPVQATLSSLKMLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYAHTLVLTDEGQVYAWGANSYGQLGTGNKSNQSYPTPVTVEKDRIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 61253 - protein, 503 aa, Homo sapiens
MLQDGSCKQMLLMLLIVQPVQATLSSLKMLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 61254 - protein, 556 aa, Homo sapiens
PCSNRYPGGGADKAPACEEPVQATLSSLKMLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYAHTLVLTDEGQVYAWGANSYGQLGTGNKSNQSYPTPVTVEKDRIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 61255 - protein, 277 aa, Homo sapiens
MSGVTTETGSLDSATVATSQPLAEWQLCKASVSRGIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 61256 - protein, 281 aa, Homo sapiens
MLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRDYRDCSLSLHTHVCGQDAGWARVHVGPVPGSVRDPPAPHPLLLH

SEQ ID NO: 61257 - protein, 452 aa, Homo sapiens
MSPKRIAKRRSPPADAIPKSKKVKDTRAAASRRVPGARSCQGACGPSPPDQKTRPVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 61258 - protein, 421 aa, Homo sapiens
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 61259 - protein, 421 aa, Homo sapiens; identical to SEQ ID NO: 61258

SEQ ID NO: 61260 - protein, 421 aa, Homo sapiens; identical to SEQ ID NO: 61258

SEQ ID NO: 61261 - protein, 230 aa, Homo sapiens
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVM

SEQ ID NO: 61262 - protein, 283 aa, Homo sapiens
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIP

SEQ ID NO: 61263 - protein, 235 aa, Homo sapiens
MAREECKALLDGLNKTTACYHHLVLTVGGSADSQNLRQELQKTRQKAQELAVSTCARLTAVLRDRGLAADERAEFERLWVAFSGCLDLLEADMRRALELGAAFPLHAPRRPLVRTGVAGASSGVAARALSTRSLRLEAEGDFDVADLRELEREVLQVGEMIDNMEMKVNVPRWTVQARQAAGAELLSTVSAGPSSVVSLQERGGGCDPRKALAAILFGAVLLAAVALAVCVAKLS

SEQ ID NO: 61264 - protein, 209 aa, Homo sapiens
MRAAAISTPKLDKMPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 61265 - protein, 347 aa, Homo sapiens
MPGKPKHLGVPNGRMVLAVSDGELSSTTGPQGQGEGRGSSLSIHSLPSGPSSPFPTFVSSKSESHRKSLGSTEGESESRPGKYCCVYLPDGTASLALARPGLTIRDMLAGICEKRGLSLPDIKVYLVGNEQKALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGLVELLNRVQSSGAHDQRGLLRKEDLVLPEFLQLPAQGPSSEETPPQTKSAAQPIGGSLNSTTDSAL

SEQ ID NO: 61266 - protein, 566 aa, Homo sapiens
MPGKPKHLGVPNGRMVLAVSDGELSSTTGPQGQGEGRGSSLSIHSLPSGPSSPFPTEEQPVASWALSFERLLQDPLGLAYFTEFLKKEFSAENVTFWKACERFQQIPASDTQQLAQEARNIYQEFLSSQALSPVNIDRQAWLGEEVLAEPRPDMFRAQQLQIFNLMKFDSYARFVKSPLYRECLLAEAEGRPLREPGSSRLGSPDATRKKPKLKPGKSLPLGVEELGQLPPVEGPGGRPLRKSFRRELGGTANAALRRESQGSLNSSASLDLGFLAFVSSKSESHRKSLGSTEGESESRPGKYCCVYLPDGTASLALARPGLTIRDMLAGICEKRGLSLPDIKVYLVGNEQALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGLVELLNRVQSSGAHDQRGLLRKEDLVLPEFLQLPAQGPSSEETPPQTKSAAQPIGGSLNSTTDSAL

SEQ ID NO: 61267 - protein, 437 aa, Homo sapiens
  MOD_RES (1)..(1): Any amino acid
XSPVNIDRQAWLGEEVLAEPRPDMFRAQQLQIFNLMKFDSYARFVKSPLYRECLLAEAEGRPLREPGSSRLGSPDATRKKPKLKPGKSLPLGVEELGQLPPVEGPGGRPLRKSFRRELGGTANAALRRESQGSLNSSASLDLGFLAFVSSKSESHRKSLGSTEGESESRPGKYCCVYLPDGTASLALARPGLTIRDMLAGICEKRGLSLPDIKVYLVGNEQKALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGLVELLNRVQSSGAHDQRGLLRKEDLVLPEFLQLPAQGPSSEETPPQTKSAAQPIGGSLNSTTDSAL

SEQ ID NO: 61268 - protein, 202 aa, Homo sapiens
MCRTLAAFPTTCLERAKEFKTRLGIFLHKSELGCDTGSTGKFEWGSKHSKENRNFSEDVLGWRESFDLLLSSKNGVAAFHAFLKTEFSEENLEFWLACEEFKKIRSATKLASRAHQIFEEFICSEAPKEVNIDHETHELTRMNLQTATATCFDAAQGKTRTLMEKDSYPRFLKSPAYRDLAAQASAASATLSSCSLDEPSHT

SEQ ID NO: 61269 - protein, 152 aa, Homo sapiens
MPVKCCFYRSPTAETMTWSENMDTLLANQAGLDAFRIFLKSEFSEENVEFWLACEDFKKTKNADKIASKAKMIYSEFIEADAPKEINIDFGTRDLISKNIAEPTLKCFDEAQKLIYCLMAKDSFPRFLKSEIYKKLVNSQQVPNHKKWLPFL

SEQ ID NO: 61270 - protein, 602 aa, Homo sapiens
MERSLHRVSLGSRRAHPDLSFYLTTFGQLRLSIDAQDRVLLLHIIEGKGLISKQPGTCDPYVKISLIPEDSRLRHQKTQTVPDCRDPAFHEHFFFPVQEEDDQKRLLVTVWNRASQSRQSGLIGCMSFGVKSLLTPDKEISGWYYLLGEHLGRTKHLKVARRRLRPLRDPLLRMPGGGDTENGKKLKITIPRGKDGFGFTICCDSPVRVQAVDSGGPAERAGLQQLDTVLQLNERPVEHWKCVELAHEIRSCPSEIILLVWRMVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKKLHPFGSLQQEMGPVNSTNATQDRSFTSPGQTLIG

SEQ ID NO: 61271 - protein, 168 aa, Homo sapiens
MKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 61272 - protein, 917 aa, Homo sapiens
MNRFNGLCKVCSERRYRQITIPRGKDGFGFTICCDSPVRVQAVDSGGPAERAGLQQLDTVLQLNERPVEHWKCVELAHEIRSCPSEIILLVWRMVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKMFETEADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQESPTRDLPPCQDLPPSQVSLPAKALTEDTMSSGDLLAATGDPPAAPRPAFVIPEVRLDSTYSQKAGAEQGCSGDEEDAEEAEEVEEGEEGEEDEDEDTSDDNYGERSEAKRSSMIETGQGAEGGLSLRVQNSLRRRTHSEGSLLQEPRGPCFASDTTLHCSDGEGAASTWGMPSPSTLKKELGRNGGSMHHLSLFFTGHRKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 61273 - protein, 1198 aa, Homo sapiens
MPVIPALWEVEMGRSQGQEIETILANRSHSDSTPLPNFLSGSHRPECCTCRLLTASGAQDSLPFGRRLYSGPWRSCEEVCHVSVLSVLSTSCGLSLSLPIFPGWMEWLSPDIALPRRDEWTQTSPARKRITHAKVQGAGQLRLSIDAQDRVLLLHIIEGKGLISKQPGTCDPYVKISLIPEDSRLRHQKTQTVPDCRDPAFHEHFFFPVQEEDDQKRLLVTVWNRASQSRQSGLIGCMSFGVKSLLTPDKEISGWYYLLGEHLGRTKHLKVARRRLRPLRDPLLRMPGGGDTENGKKLKITIPRGKDGFGFTICCDSPVRVQAVDSGGPAERAGLQQLDTVLQLNERPVEHWKCVELAHEIRSCPSEIILLVWRMVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKMFETEADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQESPTRDLPPCQDLPPSQVSLPAKALTEDTMSSGDLLAATGDPPAAPRPAFVIPEVRLDSTYSQKAGAEQGCSGDEEDAEEAEEVEEGEEGEEDEDEDTSDDNYGERSEAKRSSMIETGQGAEGGLSLRVQNSLRRRTHSEGSLLQEPRGPCFASDTTLHCSDGEGAASTWGMPSPSTLKKELGRNGGSMHHLSLFFTGHRKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 61274 - protein, 519 aa, Homo sapiens
MFETEADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQESPTRDLPPCQDLPPSQVSLPAKALTEDTMSSGDLLAATGDPPAAPRPAFVIPEVRLDSTYSQKAGAEQGCSGDEEDAEEAEEVEEGEEGEEDEDEDTSDDNYGERSEAKRSSMIETGQGAEGGLSLRVQNSLRRRTHSEGSLLQEPRGPCFASDTTLHCSDGEGAASTWGMPSPSTLKKELGRNGGSMHHLSLFFTGHRKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 61275 - protein, 1198 aa, Homo sapiens; identical to SEQ ID NO: 61273

SEQ ID NO: 61276 - protein, 591 aa, Homo sapiens
MNRFNGLCKVCSERRYRQITIPRGKDGFGFTICCDSPVRVQAVDSGGPAERAGLQQLDTVLQLNERPVEHWKCVELAHEIRSCPSEIILLVWRMVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 61277 - protein, 519 aa, Homo sapiens; identical to SEQ ID NO: 61274

SEQ ID NO: 61278 - protein, 311 aa, Homo sapiens
MVTRRPVTNSWDWLPAGAAPEAVPCRHMPLSRLPLRVGQKEFFFPLPLLVPPISWLLLSESQPRLVPGSPVIRPGFQRACVAAACTVAARCPGRGVGDRSQSGASYRPICGPKVGGPTEMLRGMYLTRNGNLQRRHTMKEAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 61279 - protein, 187 aa, Homo sapiens
MKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 61280 - protein, 93 aa, Homo sapiens
MCKGLAGLPASCLRSAKDMKHRLGFLLQKSDSCEHNSSHNKKDKVVICQRVSQEEVKKWAESLENLISHECEPGFLHQGRDKPEHARAYNNLL

SEQ ID NO: 61281 - protein, 205 aa, Homo sapiens
MCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 61282 - protein, 302 aa, Homo sapiens
MYNMMLLIQKRKGIGSQLLRAGEAEGDRGAGTAERSSDWLDGRSWAIKETPTGLAGRRSEDSDNIFTGEEAKYAQSRSHSSSCRISFLLANSKLLNKMCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 61283 - protein, 187 aa, Homo sapiens; identical to SEQ ID NO: 61279

SEQ ID NO: 61284 - protein, 143 aa, Homo sapiens
MKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLME

SEQ ID NO: 61285 - protein, 181 aa, Homo sapiens
MCKGLAALPHSCLERAKEIKIKLGILLQKPDSVGDLVIPYNEKPEKPAKTQKTSLDEALQWRDSLDKLLQNNYGLASFKSFLKSEFSEENLEFWIACEDYKKIKSPAKMAEKAKQIYEEFIQTEAPKEVNIDHFTKDITMKNLVEPSLSSFDMAQKRIHALMEKDSLPRFVRSEFYQELIK

SEQ ID NO: 61286 - protein, 201 aa, Homo sapiens
MCARNISQDILILQMHSAHWHINGKYEEKSNLMFWAKEIKIKLGILLQKPDSVGDLVIPYNEKPEKPAKTQKTSLDEALQWRDSLDKLLQNNYGLASFKSFLKSEFSEENLEFWIACEDYKKIKSPAKMAEKAKQIYEEFIQTEAPKEVNIDHFTKDITMKNLVEPSLSSFDMAQKRIHALMEKDSLPRFVRSEFYQELIK

SEQ ID NO: 61287 - protein, 73 aa, Homo sapiens
MAEKAKQIYEEFIQTEAPKEVNIDHFTKDITMKNLVEPSLSSFDMAQKRIHALMEKDSLPRFVRSEFYQELIK

SEQ ID NO: 61288 - protein, 453 aa, Homo sapiens
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVGKSLAGKRLTGLMQSS

SEQ ID NO: 61289 - protein, 460 aa, Homo sapiens
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKVWLL

SEQ ID NO: 61290 - protein, 472 aa, Homo sapiens
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKGKSLAGKRLTGLMQSS

SEQ ID NO: 61291 - protein, 480 aa, Homo sapiens
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVCLQLLF

SEQ ID NO: 61292 - protein, 475 aa, Homo sapiens
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVG

SEQ ID NO: 61293 - protein, 477 aa, Homo sapiens
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVLLF

SEQ ID NO: 61294 - protein, 539 aa, Homo sapiens
MKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVNVQNTRPAGAWSIFMAALPMAVWLRTPRSCHGLSESRLLGLPSLHDGLREGQSLPQSCPGSSSTAAEGARERASNGRSLARRQHCQCHGQGEETQLCLWSRLESSKRSQRASSLRTSKAKKKRQTVKQGPKAWP

SEQ ID NO: 61295 - protein, 432 aa, Homo sapiens
IEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKVWLL

SEQ ID NO: 61296 - protein, 346 aa, Homo sapiens
MQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVLWLLFPLGKRP

SEQ ID NO: 61297 - protein, 490 aa, Homo sapiens
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVGKSLAGKRLTGLMQSS

SEQ ID NO: 61298 - protein, 472 aa, Homo sapiens; identical to SEQ ID NO: 61290

SEQ ID NO: 61299 - protein, 346 aa, Homo sapiens
MQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVLYSNTPLAKRP

SEQ ID NO: 61300 - protein, 472 aa, Homo sapiens; identical to SEQ ID NO: 61290

SEQ ID NO: 61301 - protein, 490 aa, Homo sapiens; identical to SEQ ID NO: 61297

SEQ ID NO: 61302 - protein, 465 aa, Homo sapiens
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKKVSKVVELP

SEQ ID NO: 61303 - protein, 451 aa, Homo sapiens
MEDVIARMQDEKNGIPIRTVKSFLSKIPSVFSGSDIVQWLIKNLTIEDPVEALHLGTLMAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKGRNIPIFPCHKNCTPTLRASTNLL

SEQ ID NO: 61304 - protein, 424 aa, Homo sapiens
MAQGNNYGQTSNGVADESPNMLVYRKMEDVIARMQDEKNGIPIRTVKSFLSKIPSVFSGSDIVQWLIKNLTIEDPAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKGRNIPIFPCHKNCTPTLRASTNLL

SEQ ID NO: 61305 - protein, 469 aa, Homo sapiens
MAQGNNYGQTSNGVADESPNMLVYRKMEDVIARMQDEKNGIPIRTVKSFLSKIPSVFSGSDIVQWLIKNLTIEDPVEALHLGTLMAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKGKSLTSKRLTSLAQSY

SEQ ID NO: 61306 - protein, 477 aa, Homo sapiens
MAQGNNYGQTSNGVADESPNMLVYRKMEDVIARMQDEKNGIPIRTVKSFLSKIPSVFSGSDIVQWLIKNLTIEDPVEALHLGTLMAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKGRNIPIFPCHKNCTPTLRASTNLL

SEQ ID NO: 61307 - protein, 469 aa, Homo sapiens; identical to SEQ ID NO: 61305

SEQ ID NO: 61308 - protein, 487 aa, Homo sapiens
MAQGNNYGQTSNGVADESPNMLVYRKMEDVIARMQDEKNGIPIRTVKSFLSKIPSVFSGSDIVQWLIKNLTIEDPVEALHLGTLMAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKSGNSMDRRTSFEKFAQNVGKSLTSKRLTSLAQSY

SEQ ID NO: 61309 - protein, 424 aa, Homo sapiens; identical to SEQ ID NO: 61304

SEQ ID NO: 61310 - protein, 495 aa, Homo sapiens
MAQGNNYGQTSNGVADESPNMLVYRKMEDVIARMQDEKNGIPIRTVKSFLSKIPSVFSGSDIVQWLIKNLTIEDPVEALHLGTLMAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKSGNSMDRRTSFEKFAQNVGRNIPIFPCHKNCTPTLRASTNLL

SEQ ID NO: 61311 - protein, 326 aa, Homo sapiens
QAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKSGNSMDRRTSFEKFAQNVGRNIPIFPCHKNCTPTLRASTNLL

SEQ ID NO: 61312 - protein, 393 aa, Homo sapiens
MAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKGRNIPIFPCHKNCTPTLRASTNLL

SEQ ID NO: 61313 - protein, 257 aa, Homo sapiens
MSSAPNGRKKRPSRSTRSSIFQISKPPLQSGDWERRGSGSESAHKTQRALDDCKMLVQEFNTQVALYRELVISIGDVSVSCPSLRAEMHKTRTKGCEMARQAHQKLAAISGPEDGEIHPEICRLYIQLQCCLEMYTTEMLKSICLLGSLQFHRKGKEPGGGTKSLDCKIEESAETPALEDSSSSPVDSQQHSWQVSTDIENTERDMREMKNLLSKLRETMPLPLKNQDDSSLLNLTPYPLVRRRKRRFFGLCCLISS

SEQ ID NO: 61314 - protein, 674 aa, Homo sapiens
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKVNQKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVANFFQIKMDVPTGSGTCLMDSEDAGTGESGDRATEKEVICPWESL

SEQ ID NO: 61315 - protein, 671 aa, Homo sapiens
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVANFFQIKMDVPTGSGTCLMDSEDAGTGESGDRATEKEVICPWESL

SEQ ID NO: 61316 - protein, 1335 aa, Homo sapiens
MESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMIPDLPADLFTSCLTTPIKIALRWFCMQKCVSLVPGVTLDLIEKIPGRLNDRRTPLGELNWIFTAITDTIAWNVLPRDLFQKLFRQDLLVASLFRNFLLAERIMRSYNCTPVSSPRLPPTYMHAMWQAWDLAVDICLSQLPTIIEEGTAFRHSPFFAEQLTAFQVWLTMGVENRNPPEQLPIVLQVLLSQVHRLRALDLLGRFLDLGPWAVSLALSVGIFPYVLKLLQSSARELRPLLVFIWAKILAVDSSCQADLVKDNGHKYFLSVLADPYMPAEHRTMTAFILAVIVNSYHTGQEACLQGNLIAICLEQLNDPHPLLRQWVAICLGRIWQNFDSARWCGVRDSAHEKLYSLLSDPIPEVRCAAVFALGTFVGNSAERTDHSTTIDHNVAMMLAQLVSDGSPMVRKELVVALSHLVVQYESNFCTVALQFIEEEKNYALPSPATTEGGSLTPVRDSPCTPRLRSVSSYGNIRAVATARSLNKSLQNLSLTEESGGAVAFSPGNLSTSSSASSTLGSPENEEHILSFETIDKMRRASSYSSLNSLIGVSFNSVYTQIWRVLLHLAADPYPEVSDVAMKVLNSIAYKATVNARPQRVLDTSSLTQSAPASPTNKGVHIHQAGGSPPASSTSSSSLTNDVAKQPVSRDLPSGRPGTTGPAGAQYTPHSHQFPRTRKMFDKGPEQTADDADDAAGHKSFISATVQTGFCDWSARYFAQPVMKIPEEHDLESQIRKEREWRFLRNSRVRRQAQQVIQKGITRLDDQIFLNRNPGVPSVVKFHPFTPCIAVADKDSICFWDWEKGEKLDYFHNGNPRYTRVTAMEYLNGQDCSLLLTATDDGAIRVWKNFADLEKNPEMVTAWQGLSDMLPTTRGAGMVVDWEQETGLLMSSGDVRIVRIWDTDREMKVQDIPTGADSCVTSLSCDSHRSLIVAGLGDGSIRVYDRRMALSECRVMTYREHTAWVVKASLQKRPDGHIVSVSVNGDVRIFDPRMPESVNVLQIVKGLTALDIHPQADLIACGSVNQFTAIYNSSGELINNIKYYDGFMGQRVGAISCLAFHPHWPHLAVGSNDYYISVYSVEKRVR

SEQ ID NO: 61317 - protein, 329 aa, Homo sapiens
MGSPSIFVYDCSNAGLIVKSFKQFALQREQELEVAAINPNHPLAQMPLPPSMKNCIQLAACEATELLPMIPDLPADLFTSCLTTPIKIALRWFCMQKCVSLVPGVTLDLIEKIPGRLNDRRTPLGELNWIFTAITDTIAWNVLPRDLFQKLFRQDLLVASLFRNFLLAERIMRSYNCTPVSSPRLPPTYMHAMWQAWDLAVDICLSQLPTIIEEGTAFRHSPFFAEQLTAFQVWLTMGVENRNPPEQLPIVLQVLLSQVHRLRALDLLGRFLDLGPWAVSLALSVGIFPYVLKLLQSSARELRPLLVFIWAKILAVDSVSIPALLPRVM

SEQ ID NO: 61318 - protein, 1177 aa, Homo sapiens
MESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMIPDLPADLFTSCLTTPIKIALRWFCMQKCVSLVPGVTLDLIEKIPGRLNDRRTPLGELNWIFTAITDTIAWNVLPRDLFQKLFRQDLLVASLFRNFLLAERIMRSYNCTPVSSPRLPPTYMHAMWQAWDLAVDICLSQLPTIIEEGTAFRHSPFFAEQLTAFQVWLTMGVENRNPPEQLPIVLQVLLSQVHRLRALDLLGRFLDLGPWAVSLALSVGIFPYVLKLLQSSARELRPLLVFIWAKILAVDSELVVALSHLVVQYESNFCTVALQFIEEEKNYALPSPATTEGGSLTPVRDSPCTPRLRSVSSYGNIRAVATARSLNKSLQNLSLTEESGGAVAFSPGNLSTSSSASSTLGSPENEEHILSFETIDKMRRASSYSSLNSLIGVSFNSVYTQIWRVLLHLAADPYPEVSDVAMKVLNSIAYKATVNARPQRVLDTSSLTQSAPASPTNKGVHIHQAGGSPPASSTSSSSLTNDVAKQPVSRDLPSGRPGTTGPAGAQYTPHSHQFPRTRKMFDKGPEQTADDADDAAGHKSFISATVQTGFCDWSARYFAQPVMKIPEEHDLESQIRKEREWRFLRNSRVRRQAQQVIQKGITRLDDQIFLNRNPGVPSVVKFHPFTPCIAVADKDSICFWDWEKGEKLDYFHNGNPRYTRVTAMEYLNGQDCSLLLTATDDGAIRVWKNFADLEKNPEMVTAWQGLSDMLPTTRGAGMVVDWEQETGLLMSSGDVRIVRIWDTDREMKVQDIPTGADSCVTSLSCDSHRSLIVAGLGDGSIRVYDRRMALSECRVMTYREHTAWVVKASLQKRPDGHIVSVSVNGDVRIFDPRMPESVNVLQIVKGLTALDIHPQADLIACGSVNQFTAIYNSSGELINNIKYYDGFMGQRVGAISCLAFHPHWPHLAVGSNDYYISVYSVEKRVR

SEQ ID NO: 61319 - protein, 698 aa, Homo sapiens
MQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPQMYAPSSTASYFEAPGGAQVTVAASSPPAVPSHSMVGITMDVGGSPIVSSAGAYLIHGGMDSTRHSLAHTSRSSPATLQWLLDNYETAEGVSLPRSSLYNHYLRHCQEHKLDPVNAASFGKLIRSVFMGLRTRRLGTRGNSKYHYYGIRLKPDSPLNRLQEDTQYMAMRQQPMHQKPRYRPAQKTDSLGDSGSHSGLHSTPEQTMAVQSQHHQQYIDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSTLTQAIRNFAKSLEGWLTNAMSDFPQQVIQTKVGVVSAFAQTLRRYTSLNHLAQAARAVLQNTSQINQMLSDLNRVDFANVQEQASWVCQCEESVVQRLEQDFKLTLQQQSSLDQWASWLDSVVTQVLKQHAGSPSFPKAARQFLLKWSFYSSMVIRDLTLRSAASFGSFHLIRLLYDEYMFYLVEHRVAEATGETPIAVMGEFNDLASLSLTLLDKDDMGDEQRGSEAGPDARSLGEPLVKRERSDPNHSLQGI

SEQ ID NO: 61320 - protein, 979 aa, Homo sapiens
MATQAYTELQAAPPPSQPPQAPPQAQPQPPPPPPPAAPQPPQPPTAAATPQPQYVTELQSPQPQAQPPGGQKQYVTELPAVPAPSQPTGAPTPSPAPQQYIVVTVSEGAMRASETVSEASPGSTASQTGVPTQVVQQVQGTQQRLLVQTSVQAKPGHVSPLQLTNIQVPQQALPTQRLVVQSAAPGSKGGQVSLTVHGTQQVHSPPEQSPVQANSSSSKTAGAPTGTVPQQLQVHGVQQSVPVTQERSVVQATPQAPKPGPVQPLTVQGLQPVHVAQEVQQLQQVPVPHVYSSQVQYVEGGDASYTASAIRSSTYSYPETPLYTQTASTSYYEAAGTATQVSTPATSQAVASSGSMPMYVSGSQVVASSTSTGAGASNSSGGGGSGGGGGGGGGGGGGGSGSTGGGGSGAGTYVIQGGYMLGSASQSYSHTTRASPATVQWLLDNYETAEGVSLPRSTLYCHYLLHCQEQKLEPVNAASFGKLIRSVFMGLRTRRLGTRGNSKYHYYGLRIKASSPLLRLMEDQQHMAMRGQPFSQKQRLKPIQKMEGMTNGVAVGQQPSTGLSDISAQVQQYQQFLDASRSLPDFTELDLQGKVLPEGVGPGDIKAFQVLYREHCEAIVDVMVNLQFTLVETLWKTFWRYNLSQPSEAPPLAVHDEAEKRLPKAILVLLSKFEPVLQWTKHCDNVLYQGLVEILIPDVLRPIPSALTQAIRNFAKSLESWLTHAMVNIPEEMLRVKVAAAGAFAQTLRRYTSLNHLAQAARAVLQNTAQINQMLSDLNRVDFANVQEQASWVCRCEDRVVQRLEQDFKVTLQQQNSLEQWAAWLDGVVSQVLKPYQGSAGFPKAAKLFLLKWSFYSSMVIRDLTLRSAASFGSFHLIRLLYDEYMYYLIEHRVAQAKGETPIAVMGEFANLATSLNPLDPDKDEEEEEEEESEDELPQDISLAAGGESPALGPETLEPPAKLARTDARGLFVQALPSS

SEQ ID NO: 61321 - protein, 723 aa, Homo sapiens
MQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPQMYAPSSTASYFEAPGGAQVTVAASSPPAVPSHSMVGITMDVGGSPIVSSAGAYLIHGGMDSTRHSLAHTSRSSPATLEMAIENLQKSEGITSHKSGLLNSHLQWLLDNYETAEGVSLPRSSLYNHYLRHCQEHKLDPVNAASFGKLIRSVFMGLRTRRLGTRGNSKYHYYGIRLKPDSPLNRLQEDTQYMAMRQQPMHQKPRYRPAQKTDSLGDSGSHSGLHSTPEQTMAVQSQHHQQYIDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSTLTQAIRNFAKSLEGWLTNAMSDFPQQVIQTKVGVVSAFAQTLRRYTSLNHLAQAARAVLQNTSQINQMLSDLNRVDFANVQEQASWVCQCEESVVQRLEQDFKLTLQQQSSLDQWASWLDSVVTQVLKQHAGSPSFPKAARQFLLKWSFYSSMVIRDLTLRSAASFGSFHLIRLLYDEYMFYLVEHRVAEATGETPIAVMGEFNDLASLSLTLLDKDDMGDEQRGSEAGPDARSLGEPLVKRERSDPNHSLQGI

SEQ ID NO: 61322 - protein, 698 aa, Homo sapiens; identical to SEQ ID NO: 61319

SEQ ID NO: 61323 - protein, 616 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAEEDEHAPRERSSKPKNGLENPEGGAHKKPERLAQPPKDLEARTGAGPLARGERKKSVVESSAPGANNLQVNALVARLPLLLPRAPRSLIPPIPVSPPILAPRLSSGALKVATLPLSSRAGAPPAAVPIINMILPTVPALPGPGPGPGRAPPGGLTQPRGTENREVGIGGDQGPHDKGVKRTAEVPVSEASGQAPPAKAAKQDIEDTASDAKRKRGRPRKKSGGSGERNSTPLKSAAAMESAQSSRLPWETWGSGGEGNSAGGAERPGPMGEAEKGAVLAQGQGDGTVSKGGRGPGSQHTKEAEDKIPLVPSKVSVIKGSRSQKEAFPLAKGEVDTAPQGNKDLKEHVLQSSLSQEHKDPKATPP

SEQ ID NO: 61324 - protein, 616 aa, Homo sapiens; identical to SEQ ID NO: 61323

SEQ ID NO: 61325 - protein, 596 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAEEDEHAPRERSSKPKNGLENPEGGAHKKPERLAQPPKDLEARTGAGPLARGERKKSVVESSAPGANNLQVNALVARLPLLLPRAPRSLIPPIPVSPPILAPRLSSGALKVATLPLSSRAGAPPAAVPIINMILPTVPALPGPGPGPGRAPPGGLTQPRGTENREVGIGGDQGPHDKGVKRTAEVPVSEASGQAPPAKAAKQDIEDTASDAKRKRGRPRKKSGGSGERNSTPLKSAAAMESAQSSRLPWETWGSGGEGNSAGGAERPGPMGEAEKGAVLAQGQGDGTVSKGGRGPGSQHTKEAEDKIPLVPSKVSVIKGSRSQKEAFPLAKGEVDTAPQGNKDLK

SEQ ID NO: 61326 - protein, 118 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYR

SEQ ID NO: 61327 - protein, 230 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFL

SEQ ID NO: 61328 - protein, 123 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCES

SEQ ID NO: 61329 - protein, 96 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWI

SEQ ID NO: 61330 - protein, 106 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDT

SEQ ID NO: 61331 - protein, 184 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSE

SEQ ID NO: 61332 - protein, 576 aa, Homo sapiens
MAEDEPDAKSPKTGGRAPPGGAEAGEPTTLLQRLRGTISKAVQNKVEGILQDVQKFSDNDKLYLYLQLPSGPTTGDKRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAEEDEHAPRERSSKPKNGLENPEGGAHKKPERLAQPPKDLEARTGAGPLARGERKKSVVESSAPGANNLQVNALVARLPLLLPRAPRSLIPPIPVSPPILAPRLSSGALKVATLPLSSRAGAPPAAVPIINMILPTVPALPGPGPGPGRAPPGGLTQPRGTENREVGIGGDQGPHDKGVKRTAEVPVSEASGQAPPAKAAKQDIEDTASDAKRKRGRPRKKSGGSGERNSTPLKSAAAMESAQSSRLPWETWGSGGEGNSAGGAERPGPMGEAEKGAVLAQGQGDGTVSKGGRGPGSQHTKEAEDKIPLVPSKVSVIKGSRSQKEAFPLAKGEVDTAPQGNKDLKEHVLQSSLSQEHKDPKATPP

SEQ ID NO: 61333 - protein, 616 aa, Homo sapiens; identical to SEQ ID NO: 61323

SEQ ID NO: 61334 - protein, 165 aa, Homo sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIR

SEQ ID NO: 61335 - protein, 928 aa, Homo sapiens
MAKVPELEDTFLQAQPAPQLSPGIQEDCCVQLLGKGLLVYPEETVYLAAEGQPGGEQGGGEKGEDPELPGAVKSEMHLNNGNFSSEEEDADNHDSKTKAADQYLSQKKTITQIVKDKKKQTQLTLQWLEENYIVCEGVCLPRCILYAHYLDFCRKEKLEPACAATFGKTIRQKFPLLTTRRLGTRGHSKYHYYGIGIKESSAYYHSVYSGKGLTRFSGSKLKNEGGFTRKYSLSSKTGTLLPEFPSAQHLVYQGCISKDKVDTLIMMYKTHCQCILDNAINGNFEEIQHFLLHFWQGMPDHLLPLLENPVIIDIFCVCDSILYKVLTDVLIPATMQEMPESLLADIRNFAKNWEQWVVSSLENLPEALTDKKIPIVRRFVSSLKRQTSFLHLAQIARPALFDQHVVNSMVSDIERVDLNSIGSQALLTISGSTDTESGIYTEHDSITVFQELKDLLKKNATVEAFIEWLDTVVEQRVIKTSKQNGRSLKKRAQDFLLKWSFFGARVMHNLTLNNASSFGSFHLIRMLLDEYILLAMETQFNNDKEQELQNLLDKYMKNSDASKAAFTASPSSCFLANRNKGSMVSSDAVKNESHVETTYLPLPSSQPGGLGPALHQFPAGNTDNMPLTGQMELSQIAGHLMTPPISPAMASRGSVINQGPMAGRPPSVGPVLSAPSHCSTYPEPIYPTLPQANHDFYSTSSNYQTVFRAQPHSTSGLYPHHTEHGRCMAWTEQQLSRDFFSGSCAGSPYNSRPPSSYGPSLQAQDSHNMQFLNTGSFNFLSNTGAASCQGATLPPNSPNGYYGSNINYPESHRLGSMVNQHVSVISSIRSLPPYSDIHDPLNILDDSGRKQTSSFYTDTSSPVACRTPVLASSLQTPIPSSSSQCMYGTSNQYPAQETLDSHGTSSREMVSSLPPINTVFMGTAAGGT

SEQ ID NO: 61336 - protein, 1373 aa, Homo sapiens
MAEEQQQPPPQQPDAHQQLPPSAPNSGVALPALVPGLPGTEASALQHKIKNSICKTVQSKVDCILQEVEKFTDLEKLYLYLQLPSGLSNGEKSDQNAMSSSRAQQMHAFSWIRNTLEEHPETSLPKQEVYDEYKSYCDNLGYHPLSAADFGKIMKNVFPNMKARRLGTRGKSKYCYSGLRKKAFVHMPTLPNLDFHKTGDGLEGAEPSGQLQNIDEEVISSACRLVCEWAQKVLSQPFDTVLELARFLVKSHYIGTKSMAALTVMAAAPAGMKGITQPSAFIPTAESNSFQPQVKTLPSPIDAKQQLQRKIQKKQQEQKLQSPLPGESAAKKSESATSNGVTNLPNGNPSILSPQPIGIVVAAVPSPIPVQRTRQLVTSPSPMSSSDGKVLPLNVQVVTQHMQSVKQAPKTPQNVPASPGGDRSARHRYPQILPKPANTSALTIRSPTTVLFTSSPIKTAVVPASHMSSLNVVKMTTISLTPSNSNTPLKHSASVSSATGTTEESRSVPQIKNGSVVSLQSPGSRSSSAGGTSAVEVKVEPETSSDEHPVQCQENSDEAKAPQTPSALLGQKSNTDGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDKTKLEWMNNGYSGVGNSSVSGHGILPSYQELVEDRFRKPHAFAVPGQSYQSQSRHHDTNFGRLTPVSPVQHQGATVNNTNKQEGFAVPAPLDNKGTNSSASSNFRCRSVSPAVHRQRNLSGSTLYPVSNIPRSNVTPFGSPVTPEVHVFTNVHTDACANNIAQRSQSVPLTVMMQTAFPNALQKQANSKKITNVLLSKLDSDNDDAVRGLGMNNLPSNYTARMNLTQILEPSTVFPSANPQNMIDSSTSVYEFQTPSYLTKSNSTGQINFSPGDNQAQSEIGEQQLDFNSTVKDLLSGDSLQTNQQLKYPDVLGE

SEQ ID NO: 61337 - protein, 1281 aa, Homo sapiens
MSSSRAQQMHAFSWIRNTLEEHPETSLPKQEVYDEYKSYCDNLGYHPLSAADFGKIMKNVFPNMKARRLGTRGKSKYCYSGLRKKAFVHMPTLPNLDFHKTGDGLEGAEPSGQLQNIDEEVISSACRLVCEWAQKVLSQPFDTVLELARFLVKSHYIGTKSMAALTVMAAAPAGMKGITQPSAFIPTAESNSFQPQVKTLPSPIDAKQQLQRKIQKKQQEQKLQSPLPGESAAKKSESATSNGVTNLPNGNPSILSPQPIGIVVAAVPSPIPVQRTRQLVTSPSPMSSSDGKVLPLNVQVVTQHMQSVKQAPKTPQNVPASPGGDRSARHRYPQILPKPANTSALTIRSPTTVLFTSSPIKTAVVPASHMSSLNVVKMTTISLTPSNSNTPLKHSASVSSATGTTEESRSVPQIKNGSVVSLQSPGSRSSSAGGTSAVEVKVEPETSSDEHPVQCQENSDEAKAPQTPSALLGQKSNTDGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDKTKLEWMNNGYSGVGNSSVSGHGILPSYQELVEDRFRKPHAFAVPGQSYQSQSRHHDTNFGRLTPVSPVQHQGATVNNTNKQEGFAVPAPLDNKGTNSSASSNFRCRSVSPAVHRQRNLSGSTLYPVSNIPRSNVTPFGSPVTPEVHVFTNVHTDACANNIAQRSQSVPLTVMMQTAFPNALQKQANSKKITNVLLSKLDSDNDDAVRGLGMNNLPSNYTARMNLTQILEPSTVFPSANPQNMIDSSTSVYEFQTPSYLTKSNSTGQINFSPGDNQAQSEIGEQQLDFNSTVKDLLSGDSLQTNQQLCSCPSSLLAGMQM

SEQ ID NO: 61338 - protein, 1460 aa, Homo sapiens
MAEEQQQPPPQQPDAHQQLPPSAPNSGVALPALVPGLPGTEASALQHKIKNSICKTVQSKVDCILQEVEKFTDLEKLYLYLQLPSGLSNGEKSDQNAMSSSRAQQMHAFSWIRNTLEEHPETSLPKQEVYDEYKSYCDNLGYHPLSAADFGKIMKNVFPNMKARRLGTRGKSKYCYSGLRKKAFVHMPTLPNLDFHKTGDGLEGAEPSGQLQNIDEEVISSACRLVCEWAQKVLSQPFDTVLELARFLVKSHYIGTKSMAALTVMAAAPAGMKGITQPSAFIPTAESNSFQPQVKTLPSPIDAKQQLQRKIQKKQQEQKLQSPLPGESAAKKSESATSNGVTNLPNGNPSILSPQPIGIVVAAVPSPIPVQRTRQLVTSPSPMSSSDGKVLPLNVQVVTQHMQSVKQAPKTPQNVPASPGGDRSARHRYPQILPKPANTSALTIRSPTTVLFTSSPIKTAVVPASHMSSLNVVKMTTISLTPSNSNTPLKHSASVSSATGTTEESRSVPQIKNGSVVSLQSPGSRSSSAGGTSAVEVKVEPETSSDEHPVQCQENSDEAKAPQTPSALLGQKSNTDGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDKTKLEWMNNGYSGVGNSSVSGHGILPSYQELVEDRFRKPHAFAVPGQSYQSQSRHHDTNFGRLTPVSPVQHQGATVNNTNKQEGFAVPAPLDNKGTNSSASSNFRCRSVSPAVHRQRNLSGSTLYPVSNIPRSNVTPFGSPVTPEVHVFTNVHTDACANNIAQRSQSVPLTVMMQTAFPNALQKQANSKKITNVLLSKLDSDNDDAVRGLGMNNLPSNYTARMNLTQILEPSTVFPSANPQNMIDSSTSVYEFQTPSYLTKSNSTGQINFSPGDNQAQSEIGEQQLDFNSTVKDLLSGDSLQTNQQLVGQGASDLTNTASDFSSDIRLSSELSGSINDLNTLDPNLLFDPGRQQGQDDEATLEELKNDPLFQQICSESMNSMTSSGFEWIESKDHPTVEMLG

SEQ ID NO: 61339 - protein, 1363 aa, Homo sapiens
MSSSRAQQMHAFSWIRNTLEEHPETSLPKQEVYDEYKSYCDNLGYHPLSAADFGKIMKNVFPNMKARRLGTRGKSKYCYSGLRKKAFVHMPTLPNLDFHKTGDGLEGAEPSGQLQNIDEEVISSACRLVCEWAQKVLSQPFDTVLELARFLVKSHYIGTKSMAALTVMAAAPAGMKGITQPSAFIPTAESNSFQPQVKTLPSPIDAKQQLQRKIQKKQQEQKLQSPLPGESAAKKSESATSNGVTNLPNGNPSILSPQPIGIVVAAVPSPIPVQRTRQLVTSPSPMSSSDGKVLPLNVQVVTQHMQSVKQAPKTPQNVPASPGGDRSARHRYPQILPKPANTSALTIRSPTTVLFTSSPIKTAVVPASHMSSLNVVKMTTISLTPSNSNTPLKHSASVSSATGTTEESRSVPQIKNGSVVSLQSPGSRSSSAGGTSAVEVKVEPETSSDEHPVQCQENSDEAKAPQTPSALLGQKSNTDGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDKTKLEWMNNGYSGVGNSSVSGHGILPSYQELVEDRFRKPHAFAVPGQSYQSQSRHHDTNFGRLTPVSPVQHQGATVNNTNKQEGFAVPAPLDNKGTNSSASSNFRCRSVSPAVHRQRNLSGSTLYPVSNIPRSNVTPFGSPVTPEVHVFTNVHTDACANNIAQRSQSVPLTVMMQTAFPNALQKQANSKKITNVLLSKLDSDNDDAVRGLGMNNLPSNYTARMNLTQILEPSTVFPSANPQNMIDSSTSVYEFQTPSYLTKSNSTGQINFSPGDNQAQSEIGEQQLDFNSTVKDLLSGDSLQTNQQLVGQGASDLTNTASDFSSDIRLSSELSGSINDLNTLDPNLLFDPGRQQGQDDEATLEELKNDPLFQQICSESMNSMTSSGFEWIESKDHPTVEMLG

SEQ ID NO: 61340 - protein, 260 aa, Homo sapiens
MELTQPAEDLIQTQQTPASELGDPEDPGEEAADGSDTVVLSLFPCTPEPVNPEPDASVSSPQAGSSLKHSTTLTNRQRGNEVSALPATLDSLSIHQLAAQGELDQLKEHLRKGDNLVNKPDERGFTPLIWASAFGEIETVRFLLEWGADPHILAKERESALSLASTGGYTDIVGLLLERDVDINIYDWNGGTPLLYAVRGNHVKCVEALLARGADLTTEADSGYTPMDLAVALGYRKVQQVIENHILKLFQSNLVPADPE

SEQ ID NO: 61341 - protein, 237 aa, Homo sapiens
MELTQPAEDLIQTQQTPASELGDPEDPGEEAADGSDTVVLSLFPCTPEPVNPEPDASVSSPQGSSLKHSTTLTNRQRGNEVSALPATLDCDNLVNKPDERGFTPLIWASAFGEIETVRFLLEWGADPHILAKERESALSLASTGGYTDIVGLLLERDVDINIYDWNGGTPLLYAVRGNHVKCVEALLARGADLTTEADSGYTPMDLAVALGYRKVQQVIENHILKLFQSNLVPADPE

SEQ ID NO: 61342 - protein, 63 aa, Homo sapiens
MELTQPAEDLIQTQQTPASELGDPEDPGEEAADGSDTVVLSLFPCTPEPVNPEPDASVSSPQA

SEQ ID NO: 61343 - protein, 238 aa, Homo sapiens
MELTQPAEDLIQTQQTPASELGDPEDPGEEAADGSDTVVLSLFPCTPEPVNPEPDASVSSPQAGSSLKHSTTLTNRQRGNEVSALPATLDCDNLVNKPDERGFTPLIWASAFGEIETVRFLLEWGADPHILAKERESALSLASTGGYTDIVGLLLERDVDINIYDWNGGTPLLYAVRGNHVKCVEALLARGADLTTEADSGYTPMDLAVALGYRKVQQVIENHILKLFQSNLVPADPE

SEQ ID NO: 61344 - protein, 272 aa, Homo sapiens
MEAQGVAEGAGPGAASGVPHPAALAPAAAPTLAPASVAAAASQFTLLVMQPCAGQDEAAAPGGSVGAGKPVRYLCEGAGDGEEEAGEDEADLLDTSDPPGGGESAASLEDLEDEETHSGGEGSSGGARRRGSGGGSMSKTCTYEGCSETTSQVAKQRKPWMCKKHRNKMYKDKYKKKKSDQALNCGGTASTGSAGNVKLEESADNILSIVKQRTGSFGDRPARPTLLEQVLNQKRLSLLRSPEVVQFLQKQQQLLNQQVLEQRQQQFPGTSM

SEQ ID NO: 61345 - protein, 617 aa, Homo sapiens
MSSLPTSDGFNHPARSSGQSPDVGNPMSLARSVSASVCPIKPSDSDRIEPKAVKALKASAEFQLNSEKKEHLSLQDLSDHASSADHAPTDQSPAMPMQNSSEEITVAGNLEKSAERSTQGLKFHLHTRQEASLSVTSTRMHEPQMFLGEKDWHPENQNLSQVSDPQQHEEPGNEQYEVAQQKASHDQEYLCNIGDLELPEERQQNQHKIVDLEATMKGNGLPQNVDPPSAKKSIPSSECSGCSNSETFMEIDTAQQSLVTLLNSTGRQNANVKNIGALDLTLDNPLMEVETSKCNPSSEILNDSISTQDLQPPETNVEIPGTNKEYGHYSSPSLCGSCQPSVESAEESCPSITAALKELHELLVVSSKPASENTSEEVICQSETIAEGQTSIKDLSERWTQNEHLTQNEQCPQVSFHQAISVSVETEKLTGTSSDTGREAVENVNFRSLGDGLSTDKEGVPKSRESINKNRSVTVTSAKTSNQLHCTLGVEISPKLLAGEEDALNQTSEQTKSLSSNFILVKDLGQGIQNSVTDRPETRENVCPDASRPLLEYEPPTSHPSSSPAILPPLIFPATDIDRILRAGFTLQEALGALHRVGGNADLALLVLLAKNIVVPT

SEQ ID NO: 61346 - protein, 218 aa, Homo sapiens
MSSGAASGTGRGRPRGGGPGPGDPPPSETHKLVVVGGGGVGKSALTIQFIQSYFVSDYDPTIEDSYTKICSVDGIPARLDILDTAGQEEFGAMREQYMRAGHGFLLVFAINDRQSFNEVGKLFTQILRVKDRDDFPVVLVGNKADLESQRQVPRSEASAFGASHHVAYFEASAKLRLNVDEAFEQLVRAVRKYQEQELPPSPPSAPRKKGGGCPCVLL

SEQ ID NO: 61347 - protein, 204 aa, Homo sapiens
MAAAGWRDGSGQEKYRLVVVGGGGVGKSALTIQFIQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 61348 - protein, 127 aa, Homo sapiens
MREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 61349 - protein, 127 aa, Homo sapiens; identical to SEQ ID NO: 61348

SEQ ID NO: 61350 - protein, 127 aa, Homo sapiens; identical to SEQ ID NO: 61348

SEQ ID NO: 61351 - protein, 69 aa, Homo sapiens
MREQYMRTGEGFLLVFSVTDRGSFEEIYKFQRQILRVKDRDEFPMILIGNKADLDHQRQVTQEEGQQLA

SEQ ID NO: 61352 - protein, 127 aa, Homo sapiens; identical to SEQ ID NO: 61348

SEQ ID NO: 61353 - protein, 127 aa, Homo sapiens; identical to SEQ ID NO: 61348

SEQ ID NO: 61354 - protein, 169 aa, Homo sapiens
MSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 61355 - protein, 210 aa, Homo sapiens
MAAAGWRDGSGQEKYRLVVVGGGGVGKSALTIQFIQFFLFLQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 61356 - protein, 117 aa, Homo sapiens
MPRLFLFHLLEFCLLLNQFSRAVAAKWKDDVIKLCGRELVRAQIAICGMSTWSKRSLSQEDAPQTPRPVAGDFIQTVSLGISPDGGKALRTGSCFTREFLGALSKLYHPSSTKIQKL

SEQ ID NO: 61357 - protein, 185 aa, Homo sapiens
MPRLFLFHLLEFCLLLNQFSRAVAAKWKDDVIKLCGRELVRAQIAICGMSTWSKRSLSQEDAPQTPRPVAEIVPSFINKDTETIIIMLEFIANLPPELKAALSERQPSLPELQQYVPALKDSNLSFEEFKKLIRNRQSEAADSNPSELKYLGLDTHSQKKRRPYVALFEKCCLIGCTKRSLAKYC

SEQ ID NO: 61358 - protein, 142 aa, Homo sapiens
MARYMLLLLLAVWVLTGELWPGAEARAAPYGVRLCGREFIRAVIFTCGGSRWRRSDILAHEAMGDTFPDADADEDSLAGELDEAMGSSEWLALTKSPQAFYRGRPSWQGTPGVLRGSRDVLAGLSSSCCKWGCSKSEISSLC

SEQ ID NO: 61359 - protein, 430 aa, Homo sapiens
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPWGVPRVPCQPCSWAPLGTHGCDEWGRRARRGVEVAAGASSGGETRQPGNGTRAGGPEETAAQYAVIAIVPVFCLMGLLGILVCNLLKRKGYHCTAHKEVGPGPGGGGSGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 61360 - protein, 430 aa, Homo sapiens; identical to SEQ ID NO: 61359

SEQ ID NO: 61361 - protein, 298 aa, Homo sapiens
MHPGCWVQEALVLNHEGDMGFSEPGSHICRALGGLSPKCTCSGPLRRPGLPSAGRSWFSSGVRLPPSPGSGPFSSPGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 61362 - protein, 101 aa, Homo sapiens
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPW

SEQ ID NO: 61363 - protein, 1441 aa, Homo sapiens
MATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 61364 - protein, 1410 aa, Homo sapiens
MATAAAAAAVMAPPGCPGSCPNFAVVCSFLERYGPLLDLPELPFPELERVLQAPPPDVGNGEVPKELVELHLKLMRKIGKSVTADRWEKYLIKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 61365 - protein, 1189 aa, Homo sapiens
MKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 61366 - protein, 803 aa, Homo sapiens
ETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKK

SEQ ID NO: 61367 - protein, 702 aa, Homo sapiens
ATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQK

SEQ ID NO: 61368 - protein, 276 aa, Homo sapiens
EPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTP

SEQ ID NO: 61369 - protein, 342 aa, Homo sapiens
MAQVLIVGAGMTGSLCAALLRRQTSGPLYLAVWDKAEDSGGRMTTACSPHNPQCTADLGAQYITCTPHYAKKHQRFYDELLAYGVLRPLSSPIEGMVMKEGDCNFVAPQGISSIIKHYLKESGAEVYFRHRVTQINLRDDKWEVSKQTGSPEQFDLIVLTMPVPEILQLQGDITTLISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVTNAAANCPGQMTLHHKPFLACGGDGFTQSNFDGCITSALCVLEALKNYI

SEQ ID NO: 61370 - protein, 315 aa, Homo sapiens
MAQVLIVGAGMTGSLCAALLRRQTSGPLYLAVWDKAEDSGGRMTTACSPHNPQCTADLGAQYITCTPHYAKKHQRFYDELLAYGVLRPLSSPIEGMVMKEGDCNFVAPQGISSIIKHYLKESGAEVYFRHRVTQINLRDDKWEVSKQTGSPEQFDLIVLTMPVPEILQLQGDITTLISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVPSAGVILGCAKSPWMMAIGFPI

SEQ ID NO: 61371 - protein, 232 aa, Homo sapiens
MAQVLIVGAGMTGSLCAALLRRQTSGPLYLAVWDKAEDSGAEVYFRHRVTQINLRDDKWEVSKQTGSPEQFDLIVLTMPVPEILQLQGDITTLISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVPSAGVILGCAKSPWMMAIGFPI

SEQ ID NO: 61372 - protein, 406 aa, Homo sapiens
MDGWRRMPRWGLLLLLWGSCTFGLPTDTTTFKRIFLKRMPSIRESLKERGVDMARLGPEWSQPMKRLTLGNTTSSVILTNYMDTQYYGEIGIGTPPQTFKVVFDTGSSNVWVPSSKCSRLYTACVYHKLFDASDSSSYKHNGTELTLRYSTGTVSGFLSQDIITVGGITVTQMFGEVTEMPALPFMLAEFDGVVGMGFIEQAIGRVTPIFDNIISQGVLKEDVFSFYYNRDSENSQSLGGQIVLGGSDPQHYEGNFHYINLIKTGVWQIQMKGVSVGSSTLLCEDGCLALVDTGASYISGSTSSIEKLMEALGAKKRLFDYVVKCNEGPTLPDISFHLGGKEYTLTSADYVFQESYSSKKLCTLAIHAMDIPPPTGPTWALGATFIRKFYTEFDRRNNRIGFALAR

SEQ ID NO: 61373 - protein, 403 aa, Homo sapiens
MDGWRRMPRWGLLLLLWGSCTFGLPTDTTTFKRIFLKRMPSIRESLKERGVDMARLGPEWSQPMKRLTLGNTTSSVILTNYMDTQYYGEIGIGTPPQTFKVVFDTGSSNVWVPSSKCSRLYTACVYHKLFDASDSSSYKHNGTELTLRYSTGTVSGFLSQDIITVGGITVTQMFGEVTEMPALPFMLAEFDGVVGMGFIEQAIGRVTPIFDNIISQGVLKEDVFSFYYNRNSQSLGGQIVLGGSDPQHYEGNFHYINLIKTGVWQIQMKGVSVGSSTLLCEDGCLALVDTGASYISGSTSSIEKLMEALGAKKRLFDYVVKCNEGPTLPDISFHLGGKEYTLTSADYVFQESYSSKKLCTLAIHAMDIPPPTGPTWALGATFIRKFYTEFDRRNNRIGFALAR

SEQ ID NO: 61374 - protein, 325 aa, Homo sapiens
MDTQYYGEIGIGTPPQTFKVVFDTGSSNVWVPSSKCSRLYTACVYHKLFDASDSSSYKHNGTELTLRYSTGTVSGFLSQDIITVGGITVTQMFGEVTEMPALPFMLAEFDGVVGMGFIEQAIGRVTPIFDNIISQGVLKEDVFSFYYNRDGENSQSLGGQIVLGGSDPQHYEGNFHYINLIKTGVWQIQMKGVSVGSSTLLCEDGCLALVDTGASYISGSTSSIEKLMEALGAKKRLFDYVVKCNEGPTLPDISFHLGGKEYTLTSADYVFQESYSSKKLCTLAIHAMDIPPPTGPTWALGATFIRKFYTEFDRRNNRIGFALAR

SEQ ID NO: 61375 - protein, 427 aa, Homo sapiens
MSKGLPARQDMEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQTEAVEMMDQIVHWVQEDASGLGRPQLQGAPAAEPMAVPMMLLNLVEQLGEADEELAGKYAELGDWCARRILQHVQRDGQAVLENVSEGGKELPGCLGRQQNPGHTLEAGWFLLRHCIRKGDPELRAHVIDKFLLLPFHSGWDPDHGGLFYFQDADNFCPTQLEWAMKLWWPHSEAMIAFLMGYSDSGDPVLLRLFYQVAEYTFRQFRDPEYGEWFGYLSREGKVALSIKGGPFKGCFHVPRCLAMCEEMLGALLSRPAPAPSPAPTPACRGAE

SEQ ID NO: 61376 - protein, 254 aa, Homo sapiens
MSKGLPARQDMEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQTEAVEMMDQIVHWVQEDASGLGRPQLQGAPAAEPMAVPMMLLNLVEQLGEADEELAGKYAELGDWCARRILQHVQATRWKPAGFCSVIAFGKATPNFEPT

SEQ ID NO: 61377 - protein, 784 aa, Homo sapiens
MAQLLNSILSVIDVFHKYAKGNGDCALLCKEELKQLLLAEFGDILQRPNDPETVETILNLLDQDRDGHIDFHEYLLLVFQLVQACYHKLDNKSHGGRTSQQERGQEGAQDCKFPGNTGRQHRQRHEEERQNSHHSQPERQDGDSHHGQPERQDRDSHHGQSEKQDRDSHHSQPERQDRDSHHNQSERQDKDFSFDQSERQSQDSSSGKKVSHKSTSGQAKWQGHIFALNRCEKPIQDSHYGQSERHTQQSETLGQASHFNQTNQQKSGSYCGQSERLGQELGCGQTDRQGQSSHYGQTDRQDQSYHYGQTDRQGQSSHYSQTDRQGQSSHYSQPDRQGQSSHYGQMDRKGQCYHYDQTNRQGQGSHYSQPNRQGQSSHYGQPDTQDQSSHYGQTDRQDQSSHYGQTERQGQSSHYSQMDRQGQGSHYGQTDRQGQSSHYGQPDRQGQNSHYGQTDRQGQSSHYGQTDRQGQSSHYSQPDKQGQSSHYGKIDRQDQSYHYGQPDGQGQSSHYGQTDRQGQSFHYGQPDRQGQSSHYSQMDRQGQSSHYGQTDRQGQSSHYGQTDRQGQSYHYGQTDRQGQSSHYIQSQTGEIQGQNKYFQGTEGTRKASYVEQSGRSGRLSQQTPGQEGYQNQGQGFQSRDSQQNGHQVWEPEEDSQHHQHKLLAQIQQERPLCHKGRDWQSCSSEQGHRQAQTRQSHGEGLSHWAEEEQGHQTWDRHSHESQEGPCGTQDRRTHKDEQNHQRRDRQTHEHEQSHQRRDRQTHEDKQNRQRRDRQTHEDEQNHQR

SEQ ID NO: 61378 - protein, 439 aa, Homo sapiens
MDRKGQCYHYDQTNRQGQGSHYSQPNRQGQSSHYGQPDTQDQSSHYGQTDRQDQSSHYGQTERQGQSSHYSQMDRQGQGSHYGQTDRQGQSSHYGQPDRQGQNSHYGQTDRQGQSSHYGQTDRQGQSSHYSQPDKQGQSSHYGKIDRQDQSYHYGQPDGQGQSSHYGQTDRQGQSFHYGQPDRQGQSSHYSQMDRQGQSSHYGQTDRQGQSSHYGQTDRQGQSYHYGQTDRQGQSSHYIQSQTGEIQGQNKYFQGTEGTRKASYVEQSGRSGRLSQQTPGQEGYQNQGQGFQSRDSQQNGHQVWEPEEDSQHHQHKLLAQIQQERPLCHKGRDWQSCSSEQGHRQAQTRQSHGEGLSHWAEEEQGHQTWDRHSHESQEGPCGTQDRRTHKDEQNHQRRDRQTHEHEQSHQRRDRQTHEDKQNRQRRDRQTHEDEQNHQR

SEQ ID NO: 61379 - protein, 354 aa, Homo sapiens
MEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 61380 - protein, 320 aa, Homo sapiens
MEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 61381 - protein, 356 aa, Homo sapiens
MSLWVDKYRPCSLGRLDYHKEQAAQLRNLVQCGDFPHLLVYGPSGAGKKTRIMCILRELYGVGVEKLRIEHQTITTPSKKKIEISTIASNYHLEVNPSDAGNSDRVVIQEMLKTVAQSQQLETNSQRDFKVVLLTEVDKLTKDAQHALRRTMEKYMSTCRLILCCNSTSKVIPPIRSRCLAVRVPAPSIEDICHVLSTVCKKEGLNLPSQLAHRLAEKSCRNLRKALLMCEACRVQQYPFTADQEIPETDWEVYLRETANAIVSQQTPQRLLEVRGRLYELLTHCIPPEIIMKGLLSELLHNCDGQLKGEVAQMAAYYEHRLQLGSKAIYHLEAFVAKFMALYKKFMEDGLEGMMF

SEQ ID NO: 61382 - protein, 305 aa, Homo sapiens
MSLWVDKYRPCSLGRLDYHKEQAAQLRNLVQCGDFPHLLVYGPSGAGKKTRIMCILRELYGVGVEKLRIEHQTITTPSKKKIEISTIASNYHLEVNPSDAGNSDRVVIQEMLKTVAQSQQLETNSQRDFKVVLLTEVDKLTKDAQHALRRTMEKYMSTCRLILCCNSTSKVIPPIRSRCLAVRVPAPSIEDICHVLSTVCKKEGLNLPSQLAHRLAEKSCRNLRKALLMCEACRVQQYPFTADQEIPETDWEVYLRETANAIVSQQTPQRLLEVRGRLYELLTHCIPPEIIMKACKEESRSCDIF

SEQ ID NO: 61383 - protein, 363 aa, Homo sapiens
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKIVILDEADSMTSAAQAALRRTMEKESKTTRFCLICNYVSRIIEPLTSRCSKFRFKPLSDKIQQQRLLDIAKKENVKISDEGIAYLVKVSEGDLRKAITFLQSATRLTGGKEITEKVITDIAGVIPAEKIDGVFAACQSGSFDKLEAVVKDLIDEGHAATQLVNQLHDVVVENNLSDKQKSIITEKLAEVDKCLADGADEHLQLISLCATVMQQLSQNC

SEQ ID NO: 61384 - protein, 363 aa, Homo sapiens; identical to SEQ ID NO: 61383

SEQ ID NO: 61385 - protein, 43 aa, Homo sapiens
MQAFLKGTSISTKPPLTKDRGVAASAGSSGENKKAKPVPWVEK

SEQ ID NO: 61386 - protein, 214 aa, Homo sapiens
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKIVILDEADSMTSAAQAALRRTMEKESKTTRFCLICNYVSRIIEPLTSRCSKFRFKPLSDKIQQQRLLDI

SEQ ID NO: 61387 - protein, 123 aa, Homo sapiens
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKV

SEQ ID NO: 61388 - protein, 167 aa, Homo sapiens
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKIVILDEADSMTSAAQAALRRTM

SEQ ID NO: 61389 - protein, 95 aa, Homo sapiens
MQAFLKGTSISTKPPLTKDRGVAASAGSSGENKKAKPVPWVEKYRPKCVDEVAFQEEVVAVLKKSLEGADLPNLLFYGPPGTGKTSTILAAAREL

SEQ ID NO: 61390 - protein, 255 aa, Homo sapiens
MVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAYRNITELKTLKGLALHDILTEIHLFVHRVDFPSSVRIHLLTKMADIEYRLSVGTNEKIQLSSLIAAFQVTRDLIVAEA

SEQ ID NO: 61391 - protein, 319 aa, Homo sapiens
MVEKYRPQTLNDLISHQDILSTIQKFINEDRLPHLLLYGPPGTGKTSTILACAKQLYKDKEFGSMVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAYRNITELKTLKGLALHDILTEIHLFVHRVDFPSSVRIHLLTKMADIEYRLSVGTNEKIQLSSLIAAFQVTRDLIVAEA

SEQ ID NO: 61392 - protein, 104 aa, Homo sapiens
MVEKYRPQTLNDLISHQDILSTIQKFINEDRLPHLLLYGPPGTGKTSTILACAKQLYKDKEFGSMVLELNASDDRGIDIIRGPILSFASTRTIFKKGFKLVILD

SEQ ID NO: 61393 - protein, 340 aa, Homo sapiens
METSALKQQEQPAATKIRNLPWVEKYRPQTLNDLISHQDILSTIQKFINEDRLPHLLLYGPPGTGKTSTILACAKQLYKDKEFGSMVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAYRNITELKTLKGLALHDILTEIHLFVHRVDFPSSVRIHLLTKMADIEYRLSVGTNEKIQLSSLIAAFQVTRDLIVAEA

SEQ ID NO: 61394 - protein, 63 aa, Homo sapiens
MVEKYRPQTLNDLISHQDILSTIQKFINEDRLPHLLLYGPPGTGKTSTILACAKQLYKDKEFG

SEQ ID NO: 61395 - protein, 358 aa, Homo sapiens
MWNSNDGGAGWRRKRIAGGFSKRASLGSERRVVAGEEGRERSWGVWGSPAGRRRGRLGRLGQCLKGRSLREPAGFSEAWDVAQALILLFKTGGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 61396 - protein, 278 aa, Homo sapiens
MGRGDRNKRSIRGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 61397 - protein, 270 aa, Homo sapiens
MWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 61398 - protein, 122 aa, Homo sapiens
LEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 61399 - protein, 179 aa, Homo sapiens
MWNSNDGGGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQ

SEQ ID NO: 61400 - protein, 261 aa, Homo sapiens
MSKSGFGSYGSISAADGASGGSDQLCERDATPAIKTQRPKVRIQDVVPCNVNQLLSSTVFDPVFKVRGIIVSQVSIVGVIRGAEKASNHICYKIDDMTAKPIEARQWFGREKVKQVTPLSVGVYVKVFGILKCPTGTKSLEVLKIHVLEDMNEFTVHILETVNAHMMLDKARRDTTVESVPVSPSEVNDAGDNDESHRNFIQDEVLRLIHECPHQEGKSIHELRAQLCDLSVKAIKEAIDYLTVEGHIYPTVDREHFKSAD

SEQ ID NO: 61401 - protein, 109 aa, Homo sapiens
MNPALGNQTDVAGLFLANSSEALERAVRCCTQASVVTDDGFAEGGPDERSLYIMRVVQIAVMCVLSLTVVFGIFFLGCNLLIKSEGMINFLVKDRRPSKEVEAVVVGPY

SEQ ID NO: 61402 - protein, 108 aa, Homo sapiens
MKALCLLLLPVLGLLVSSKTLCSMEEAINERIQEVAGSLIFRAISSIGLECQSVTSRGDLATCPRGFAVTGCTCGSACGSWDVRAETTCHCQCAGMDWTGARCCRVQP

SEQ ID NO: 61403 - protein, 82 aa, Homo sapiens
MKALCLLLLPVLGLLVSSKTLCSMEEAINERIQEVAGSLSFAVTGCTCGSACGSWDVRAETTCHCQCAGMDWTGARCCRVQP

SEQ ID NO: 61404 - protein, 317 aa, Homo sapiens
MKRLSLVTTNRLSPHGNFLPLCTFPLAVDMAALFQEASSCPVCSDYLEKPMSLECGCAVCFKCINSLQKEPHGEDLLCCCCSMVSQKNKIRPSWQLERLASHIKELEPKLKKILQMNPRMRKFQVDMTLDADTANNFLLISDDLRSVRSGCITQNRQDLAERFDVSICILGSPRFTCGRHYWEVDVGTSTEWDLGVCRESVHRKGRIHLTTERGFWTVSLRDGSRLSASTVPLTFLFVDRKLQRVGIFLDMGMQNVSFFDAEGGSHVYTFRSVSAEEPLHLFFAPPSPPNGDKSVLSICPVINPGTTDAPVHPGEAK

SEQ ID NO: 61405 - protein, 317 aa, Homo sapiens
MKRLSLVTTNRLSPHGNFFTLCTFPLAVDMAALFQEASSCPVCSDYLEKPMSLECGCAVCLKCINSLQKEPHGEDLLCCCSSMVSRKNKIRRNRQLERLASHIKELEPKLKKILQMNPRMRKFQVDMTLDANTANNFLLISDDLRSVRSGRIRQNRQDLAERFDVSVCILGSPRFTCGRHCWEVDVGTSTEWDLGVCRESVHRKGRIQLTTELGFWTVSLRDGGRLSATTVPLTFLFVDRKLQRVGIFLDMGMQNVSFFDAESGSHVYTFRSVSAEEPLRPFLAPSVPPNGDQGVLSICPLMNSGTTDAPVRPGEAK

SEQ ID NO: 61406 - protein, 288 aa, Homo sapiens
MAALFQEASSCPVCSDYLEKPMSLECGCAVCLKCINSLQKEPHGEDLLCCCSSMVSRKNKIRRNRQLERLASHIKELEPKLKKILQMNPRMRKFQVDMTLDANTANNFLLISDDLRSVRSGRIRQNRQDLAERFDVSVCILGSPRFTCGRHCWEVDVGTSTEWDLGVCRESVHRKGRIQLTTELGFWTVSLRDGGRLSATTVPLTFLFVDRKLQRVGIFLDMGMQNVSFFDAESGSHVYTFRSVSAEEPLRPFLAPSVPPNGDQGVLSICPLMNSGTTDAPVRPGEAK

SEQ ID NO: 61407 - protein, 288 aa, Homo sapiens; identical to SEQ ID NO: 61406

SEQ ID NO: 61408 - protein, 378 aa, Homo sapiens
MEVAELGFPETAVSQSRICLCAVLCGHWDFADMMVIRSLSLIRLEGVEGRDPVGGGNLTNKRPSCAPSPQDLSAQWKQLEDRGASSRRVDMAALFQEASSCPVCSDYLEKPMSLECGCAVCLKCINSLQKEPHGEDLLCCCSSMVSRKNKIRRNRQLERLASHIKELEPKLKKILQMNPRMRKFQVDMTLDANTANNFLLISDDLRSVRSGRIRQNRQDLAERFDVSVCILGSPRFTCGRHCWEVDVGTSTEWDLGVCRESVHRKGRIQLTTELGFWTVSLRDGGRLSATTVPLTFLFVDRKLQRVGIFLDMGMQNVSFFDAESGSHVYTFRSVSAEEPLRPFLAPSVPPNGDQGVLSICPLMNSGTTDAPVRPGEAK

SEQ ID NO: 61409 - protein, 317 aa, Homo sapiens
MKRLSLVTTNRLSPQGNFLPLCTFPLAVDMAALFQEASSCPVCSDYLEKPMSLECGCTVCLKCINSLQKEPHGEDLLCCCCSMVSQRNKIRPNRQLERLVSHIKELEPKLKKILQMNPRMRKFQVDMTLDADTANNFLLISDDLRSVRSGLITQNRQDLAERFDVSVCILGSPRFTCGRHYWEVDVGTSTEWDLGVCRESVHCKGKIQLTTELGFWTVSLRDGSRLSASTVPLTFLLVDRKLQRVGIFLDMGMQNVSFFDAESGSHVYTFRSVSAEEPLRPFLAPSIPPNGDQGVLSICPLMNSGTTDAPVRPGEAK

SEQ ID NO: 61410 - protein, 288 aa, Homo sapiens
MAALFQEASSCPVCSDYLEKPMSLECGCTVCLKCINSLQKEPHGEDLLCCCCSMVSQRNKIRPNRQLERLVSHIKELEPKLKKILQMNPRMRKFQVDMTLDADTANNFLLISDDLRSVRSGLITQNRQDLAERFDVSVCILGSPRFTCGRHYWEVDVGTSTEWDLGVCRESVHCKGKIQLTTELGFWTVSLRDGSRLSASTVPLTFLLVDRKLQRVGIFLDMGMQNVSFFDAESGSHVYTFRSVSAEEPLRPFLAPSIPPNGDQGVLSICPLMNSGTTDAPVRPGEAK

SEQ ID NO: 61411 - protein, 288 aa, Homo sapiens; identical to SEQ ID NO: 61410

SEQ ID NO: 61412 - protein, 1072 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 61413 - protein, 1114 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGMSDPNWPGESPVPLTRADGTNTGFPRYPNDSVYANWMLSPSAAKLMDTFDS

SEQ ID NO: 61414 - protein, 458 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCLADLTGDAVSGRDEARSSGLGSQKHPGS

SEQ ID NO: 61415 - protein, 261 aa, Homo sapiens
MDEALETQLKTSRGRFSATESLPTLELLSQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 61416 - protein, 224 aa, Homo sapiens
MGWQLIWAKASCTWQDLVVPQRWTQQRHRALETIQNAVECRALNANPSWNTSNVPFAVASACGYWGYARHSRSARSSARPGSPTAKMISPAARLGSHSQKKGAVSPAALPMDRLECSGAISARCNLRLRGSSDSPAATSRIAGISGACHHAQLIFVFLVESAFHHVGQAGFELLTSGDPPTSASQSVGITGVSHRPRPPPSSFLPCLDPRDRIGTPQVPAPTLP

SEQ ID NO: 61417 - protein, 229 aa, Homo sapiens
MDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 61418 - protein, 205 aa, Homo sapiens
MDEALETQLKTSRGRFSATESLPTLELLSQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQAGVQWRDLSSMQPPPPGFK

SEQ ID NO: 61419 - protein, 239 aa, Homo sapiens
MARQLLSQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 61420 - protein, 331 aa, Homo sapiens
MARGGRGRRLGLALGLLLALVLAPRVLRAKPTVRKERVVRPDSELGERPPEDNQSFQYDHEAFLGKEDSKTFDQLTPDESKERLGKIVDRIDNDGDGFVTTEELKTWIKRVQKRYIFDNVAKVWKDYDRDKDDKISWEEYKQATYGYYLGNPAEFHDSSDHHTFKKMLPRDERRFKAADLNGDLTATREEFTAFLHPEEFEHMKEIVVLETLEDIDKNGDGFVDQDEYIADMFSHEENGPEPDWVLSEREQFNEFRDLNKDGKLDKDEIRHWILPQDYDHAQAEARHLVYESDKNKDEKLTKEEILENWNMFVGSQATNYGEDLTKNHDEL

SEQ ID NO: 61421 - protein, 28 aa, Homo sapiens
EILENWNMFVGSQATNYGEDLTKNHDEL

SEQ ID NO: 61422 - protein, 317 aa, Homo sapiens
MRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 61423 - protein, 776 aa, Homo sapiens
MAAPGDPQDELLPLAGPGSQWLRHRGEGENEAVTPKGATPAPQAGEPSPGLGARAREAASREAGSGPARQSPVAMETASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKDLDFKNKDTDISIKPEGVREPDKPAPVEGKIIKDHLLEESTFAPYIDDLSEEQRRAPQITTPVKITLTEIEPSVETTTQEKTPEKQDICLKPSPDTVPTVTVSEPEDDSPGSITPPSSGTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 61424 - protein, 208 aa, Homo sapiens
MQATADSTKMDCVWSNWKSQAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 61425 - protein, 356 aa, Homo sapiens
MAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 61426 - protein, 702 aa, Homo sapiens
METASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKDLDFKNKDTDISIKPEGVREPDKPAPVEGKIIKDHLLEESTFAPYIDDLSEEQRRAPQITTPVKITLTEIEPSVETTTQEKTPEKQDICLKPSPDTVPTVTVSEPEDDSPGSITPPSSGTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 61427 - protein, 545 aa, Homo sapiens
MGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGTAMEWLKTSLLLAVYKTVPILELSPPLWTAIGWVQRGPTPPTPVLRVLLKWAKSPRSSGVPSLSLGADMGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 61428 - protein, 472 aa, Homo sapiens
MGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 61429 - protein, 205 aa, Homo sapiens
MGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 61430 - protein, 1013 aa, Homo sapiens
MAEPSAATQSHSISSSSFGAEPSAPGGGGSPGACPALGTKSCSSSCAEGLSSLCSDEPSSEIMTSSFLSSSEIHNTGLTILHGEKSHVLGSQPILAKEGKDHLDLLDMKKMEKPQGTSNNVSDSSVSLAAGVHCDRPSIPASFPEHPAFLSKKIGQVEEQIDKETKNPNGVSSREAKTALDADDRFTLLTAQKPPTEYSKVEGIYTYSLSPSKVSGDDVIEKDSPESPFEVIIDKAAFDKEFKDSYKESTDDFGSWSVHTDKESSEDISETNDKLFPLRNKEAGRYPMSALLSRQFSHTNAALEEVSRCVNDMHNFTNEILTWDLVPQVKQQTDKSSDCITKTTGLDMSEYNSEIPVVNLKTSTHQKTPVCSIDGSTPITKSTGDWAEASLQQENAITGKPVPDSLNSTKEFSIKGVQGNMQKQDDTLAELPGSPPEKCDSLGSGVATVKVVLPDDHLKDEMDWQSSALGEITEADSSGESDDTVIEDITADTSFENNKIQAEKPVSIPSAVVKTGEREIKEIPSCEREEKTSKNFEELVSDSELHQDQPDILGRSPASEAACSKVPDTNVSLEDVSEVAPEKPITTENPKLPSTVSPNVFNETEFSLNVTTSAYLESLHGKNVKHIDDSSPEDLIAAFTETRDKGIVDSERNAFKAISEKMTDFKTTPPVEVLHENESGGSEIKDIGSKYSEQSKETNGSEPLGVFPTQGTPVASLDLEQEQLTIKALKELGERQVEKSTSAQRDAELPSEEVLKQTFTFAPESWPQRSYDILERNVKNGSDLGISQKPITIRETTRVDAVSSLSKTELVKKHVLARLLTDFSVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 61431 - protein, 241 aa, Homo sapiens
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKDPSKTPWNRQKKGRISTWKPEMQQLLKHHLIVITSLLVL

SEQ ID NO: 61432 - protein, 214 aa, Homo sapiens
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKPRLITMLASPEIRPSQLLKRSKQNSLESPKKRQNKYMETRNATVTKTPFNSYNVVTCTMKENTQCQLEPAFQAFFLIWCFLPSFPFNPQYQAQKLMD

SEQ ID NO: 61433 - protein, 255 aa, Homo sapiens
MAEPSAATQSHSISSSSFGAEPSAPGGGGSPGACPALGTKSCSSSCADSFVSSSSSQPVSLFSTSQVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 61434 - protein, 1032 aa, Homo sapiens
MAEPSAATQSHSISSSSFGAEPSAPGGGGSPGACPALGTKSCSSSCADSFVSSSSSQPVSLFSTSQEGLSSLCSDEPSSEIMTSSFLSSSEIHNTGLTILHGEKSHVLGSQPILAKEGKDHLDLLDMKKMEKPQGTSNNVSDSSVSLAAGVHCDRPSIPASFPEHPAFLSKKIGQVEEQIDKETKNPNGVSSREAKTALDADDRFTLLTAQKPPTEYSKVEGIYTYSLSPSKVSGDDVIEKDSPESPFEVIIDKAAFDKEFKDSYKESTDDFGSWSVHTDKESSEDISETNDKLFPLRNKEAGRYPMSALLSRQFSHTNAALEEVSRCVNDMHNFTNEILTWDLVPQVKQQTDKSSDCITKTTGLDMSEYNSEIPVVNLKTSTHQKTPVCSIDGSTPITKSTGDWAEASLQQENAITGKPVPDSLNSTKEFSIKGVQGNMQKQDDTLAELPGSPPEKCDSLGSGVATVKVVLPDDHLKDEMDWQSSALGEITEADSSGESDDTVIEDITADTSFENNKIQAEKPVSIPSAVVKTGEREIKEIPSCEREEKTSKNFEELVSDSELHQDQPDILGRSPASEAACSKVPDTNVSLEDVSEVAPEKPITTENPKLPSTVSPNVFNETEFSLNVTTSAYLESLHGKNVKHIDDSSPEDLIAAFTETRDKGIVDSERNAFKAISEKMTDFKTTPPVEVLHENESGGSEIKDIGSKYSEQSKETNGSEPLGVFPTQGTPVASLDLEQEQLTIKALKELGERQVEKSTSAQRDAELPSEEVLKQTFTFAPESWPQRSYDILERNVKNGSDLGISQKPITIRETTRVDAVSSLSKTELVKKHVLARLLTDFSVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 61435 - protein, 123 aa, Homo sapiens
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFNWLSSCG

SEQ ID NO: 61436 - protein, 236 aa, Homo sapiens
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 61437 - protein, 373 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 61438 - protein, 1192 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVDETLFALPAASEPVIRSSAENMDLKEQPGNTISAGQEDFPSVLLETAASLPSLSPLSAASFKEHEYLGNLSTVLPTEGTLQENVSEASKEVSEKAKTLLIDRDLTEFSELEYSEMGSSFSVSPKAESAVIVANPREEIIVKNKDEEEKLVSNNILHNQQELPTALTKLVKEDEVVSSEKAKDSFNEKRVAVEAPMREEYADFKPFERVWEVKDSKEDSDMLAAGGKIESNLESKVDKKCFADSLEQTNHEKDSESSNDDTSFPSTPEGIKDRSGAYITCAPFNPAATESIATNIFPLLGDPTSENKTDEKKIEEKKAQIVTEKNTSTKTSNPFLVAAQDSETDYVTTDNLTKVTEEVVANMPEGLTPDLVQEACESELNEVTGTKIAYETKMDLVQTSEVMQESLYPAAQLCPSFEESEATPSPVLPDIVMEAPLNSAVPSAGASVIQPSSSPLEASSVNYESIKHEPENPPPYEEAMSVSLKKVSGIKEEIKEPENINAALQETEAPYISIACDLIKETKLSAEPAPDFSDYSEMAKVEQPVPDHSELVEDSSPDSEPVDLFSDDSIPDVPQKQDETVMLVKESLTETSFESMIEYENKEKLSALPPEGGKPYLESFKLSLDNTKDTLLPDEVSTLSKKEKIPLQMEELSTAVYSNDDLFISKEAQIRETETFSDSSPIEIIDEFPTLISSKTDSFSKLAREYTDLEVSHKSEIANAPDGAGSLPCTELPHDLSLKNIQPKVEEKISFSDDFSKNGSATSKVLLLPPDVSALATQAEIESIVKPKVLVKEAEKKLPSDTEKEDRSPSAIFSAELSKTSVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 61439 - protein, 960 aa, Homo sapiens
MEDLDQSPLVSSSDSPPRPQPAFKYQFVREPEDEEEEEEEEEEDEDEDLEELEVLERKQFSELEYSEMGSSFSVSPKAESAVIVANPREEIIVKNKDEEEKLVSNNILHNQQELPTALTKLVKEDEVVSSEKAKDSFNEKRVAVEAPMREEYADFKPFERVWEVKDSKEDSDMLAAGGKIESNLESKVDKKCFADSLEQTNHEKDSESSNDDTSFPSTPEGIKDRSGAYITCAPFNPAATESIATNIFPLLGDPTSENKTDEKKIEEKKAQIVTEKNTSTKTSNPFLVAAQDSETDYVTTDNLTKVTEEVVANMPEGLTPDLVQEACESELNEVTGTKIAYETKMDLVQTSEVMQESLYPAAQLCPSFEESEATPSPVLPDIVMEAPLNSAVPSAGASVIQPSSSPLEASSVNYESIKHEPENPPPYEEAMSVSLKKVSGIKEEIKEPENINAALQETEAPYISIACDLIKETKLSAEPAPDFSDYSEMAKVEQPVPDHSELVEDSSPDSEPVDLFSDDSIPDVPQKQDETVMLVKESLTETSFESMIEYENKEKLSALPPEGGKPYLESFKLSLDNTKDTLLPDEVSTLSKKEKIPLQMEELSTAVYSNDDLFISKEAQIRETETFSDSSPIEIIDEFPTLISSKTDSFSKLAREYTDLEVSHKSEIANAPDGAGSLPCTELPHDLSLKNIQPKVEEKISFSDDFSKNGSATSKVLLLPPDVSALATQAEIESIVKPKVLVKEAEKKLPSDTEKEDRSPSAIFSAELSKTSVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 61440 - protein, 986 aa, Homo sapiens
MDLKEQPGNTISAGQEDFPSVLLETAASLPSLSPLSAASFKEHEYLGNLSTVLPTEGTLQENVSEASKEVSEKAKTLLIDRDLTEFSELEYSEMGSSFSVSPKAESAVIVANPREEIIVKNKDEEEKLVSNNILHNQQELPTALTKLVKEDEVVSSEKAKDSFNEKRVAVEAPMREEYADFKPFERVWEVKDSKEDSDMLAAGGKIESNLESKVDKKCFADSLEQTNHEKDSESSNDDTSFPSTPEGIKDRSGAYITCAPFNPAATESIATNIFPLLGDPTSENKTDEKKIEEKKAQIVTEKNTSTKTSNPFLVAAQDSETDYVTTDNLTKVTEEVVANMPEGLTPDLVQEACESELNEVTGTKIAYETKMDLVQTSEVMQESLYPAAQLCPSFEESEATPSPVLPDIVMEAPLNSAVPSAGASVIQPSSSPLEASSVNYESIKHEPENPPPYEEAMSVSLKKVSGIKEEIKEPENINAALQETEAPYISIACDLIKETKLSAEPAPDFSDYSEMAKVEQPVPDHSELVEDSSPDSEPVDLFSDDSIPDVPQKQDETVMLVKESLTETSFESMIEYENKEKLSALPPEGGKPYLESFKLSLDNTKDTLLPDEVSTLSKKEKIPLQMEELSTAVYSNDDLFISKEAQIRETETFSDSSPIEIIDEFPTLISSKTDSFSKLAREYTDLEVSHKSEIANAPDGAGSLPCTELPHDLSLKNIQPKVEEKISFSDDFSKNGSATSKVLLLPPDVSALATQAEIESIVKPKVLVKEAEKKLPSDTEKEDRSPSAIFSAELSKTSVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 61441 - protein, 392 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVDETLFALPAASEPVIRSSAVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 61442 - protein, 199 aa, Homo sapiens
MDGQKKNWKDKVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 61443 - protein, 986 aa, Homo sapiens; identical to SEQ ID NO: 61440

SEQ ID NO: 61444 - protein, 345 aa, Homo sapiens [sequence omitted]

SEQ ID NO: 61445 - protein, 986 aa, Homo sapiens; identical to SEQ ID NO: 61440

SEQ ID NO: 61446 - protein, 986 aa, Homo sapiens; identical to SEQ ID NO: 61440

SEQ ID NO: 61447 - protein, 91 aa, Homo sapiens
MDLKEQPGNTISAGQEDFPSVLLETAASLPSLSPLSAASFKEHEYLGNLSTVLPTEGTLQENVSEASKEVSEKAKTLLIDRDLTEFSELEY

SEQ ID NO: 61448 - protein, 396 aa, Homo sapiens
MEFLKTCVLRRNACTAVCFWRSKVVQKPSVRRISTTSPRSTVMPAWVIDKYGKNEVLRFTQNMMMPIIHYPNEVIVKVHAASVNPIDVNMRSGYGATALNMKRDPLHVKIKGEEFPLTLGRDVSGVVMECGLDVKYFKPGDEVWAAVPPWKQGTLSEFVVVSGNEVSHKPKSLTHTQAASLPYVALTAWSAINKVGGLNDKNCTGKRVLILGASGGVGTFAIQVMKAWDAHVTAVCSQDASELVRKLGADDVIDYKSGSVEEQLKSLKPFDFILDNVGGSTETWAPDFLKKWSGATYVTLVTPFLLNMDRLGIADGMLQTGVTVGSKALKHFWKGVHYRWAFFMASGPCLDDIAELVDAGKIRPVIEQTFPFSKVPEAFLKVERGHARGKTVINVV

SEQ ID NO: 61449 - protein, 226 aa, Homo sapiens
MEFLKTCVLRRNACTAVCFWRSKVVQKPSVRRISTTSPRSTVMPAWVIDKYGKNEVLRFTQNMMMPIIHYPNEVIVKVHAASVNPIDVNMRSGYGATALNMKRDPLHVKIKGEEFPLTLGRDVSGVVMECGLDVKYFKPGDEVWAAVPPWKQGTLSEFVVVSGNEVSHKPKSLTHTQAASLPYVALTAWSAINKVGGLNDKNCTGKRISGKESIIAGHFSWPVAHV

SEQ ID NO: 61450 - protein, 473 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 61451 - protein, 346 aa, Homo sapiens
MHLPGCAPAMADGSFSLAGHLLRSPGGSTSRLHSIEAILGFTKDDGILGTFPAERGARGAKERDRRLGARPACPKAPEEGSEPSPPPAPAPAPEYEAPRPYCPKEPGEARPSPGLPVGPATGEAKLSEEEQPKKKHRRNRTTFTTYQLHELERAFEKSHYPDVYSREELAGKVNLPEVRVQVWFQNRRAKWRRQEKLEVSSMKLQDSPLLSFSRSPPSATLSPLGAGPGSGGGPAGGALPLESWLGPPLPGGGATALQSLPGFGPPAQSLPASYTPPPPPPPFLNSPPLGPGLQPLAPPPPSYPCGPGFGDKFPLDEADPRNSSIAALRLKAKEHIQAIGKPWQAL

SEQ ID NO: 61452 - protein, 74 aa, Homo sapiens
MHLPGCAPAMADGSFSLAGHLLRSPGGSTSRLHSIEAILGFTKDDGILGTFPAERGARGAKERDRRLGARPACP

SEQ ID NO: 61453 - protein, 195 aa, Homo sapiens
MSLISWLRWNEAPSRLSTRSPAEMVLETLMMELTGQMREAERQQRERSNAVRKVCTGVDYSWLASTPRSTYDLSPIERLQLEDVCVKIHPSYCGPAILRFRQLLAEQEPEVQEVSQLFRSVLQEVLERMKQEEEAHKLTRQWSLRPRGSLATFKTRARISPFASDIRTISEDVERDTPPPLRSWSMPEFRAPKAD

SEQ ID NO: 61454 - protein, 253 aa, Homo sapiens
MAETSALPTGFGELEVLAVGMVLLVEALSGLSLNTLTIFSFCKTPELRTPCHLLVLSLALADSGISLNALVAATSSLLRRWPYGSDGCQAHGFQGFVTALASICSSAAIAWGRYHHYCTRSQLAWNSAVSLVLFVWLSSAFWAALPLLGWGHYDYEPLGTCCTLDYSKGDRNFTSFLFTMSFFNFAMPLFITITSYSLMEQKLGKSGHLQVPALIAKMVPTINAINYALGNEMVCRGIWQCLSPQKREKDRTK

SEQ ID NO: 61455 - protein, 295 aa, Homo sapiens
MAETSALPTGFGELEVLAVGMVLLVEALSGLSLNTLTIFSFCKTPELRTPCHLLVLSLALADSGISLNALVAATSSLLRVSHRRWPYGSDGCQAHGFQGFVTALASICSSAAIAWGRYHHYCTRSQLAWNSAVSLVLFVWLSSAFWAALPLLGWGHYDYEPLGTCCTLDYSKGDRNFTSFLFTMSFFNFAMPLFITITSYSLMEQKLGKSGHLQVNTTLPARTLLLGWGPYAILYLYAVIADVTSISPKLQMVPALIAKMVPTINAINYALGNEMVCRGIWQCLSPQKREKDRTK

SEQ ID NO: 61456 - protein, 120 aa, Homo sapiens
MAETSALPTGFGELEVLAVGMVLLVEDPGAADSLPPTGAELGSCGQWDQPECPRCSHIQPSPCLPQALALRLGRLPGSRLPGLCDSVGQHLQQCSHRMGALSPLLHPPKCCHRSHHFEWR

SEQ ID NO: 61457 - protein, 351 aa, Homo sapiens
MAPVLPLVLPLQPRIRLAQGLWLLSWLLALAGGVILLCSGHLLVQLRHLGTFLAPSCQFPVLPQAALAAGAVALGTGLVGVGASRASLNAALYPPWRGVLGPLLVAGTAGGGGLLVVGLGLALALPGSLDEALEEGLVTALAHYKDTEVPGHCQAKRLVDELQLRYHCCGRHGYKDWFGVQWVSSRYLDPGDRDVADRIQSNVEGLYLTDGVPFSCCNPHSPRPCLQNRLSDSYAHPLFDPRQPNQNLWAQGCHEVLLEHLQDLAGTLGSMLAVTFLLQALVLLGLRYLQTALEGLGGVIDAGGETQGYLFPSGLKDMLKTAWLQGGVACRPAPEEAPPGEAPPKEDLSEA

SEQ ID NO: 61458 - protein, 533 aa, Homo sapiens
MSIQVEHPAGGYKKLFETVEELSSPLTAHVTGRIPLWLTGSLLRCGPGLFEVGSEPFYHLFDGQALLHKFDFKEGHVTYHRRFIRTDAYVRAMTEKRIVITEFGTCAFPDPCKNIFSRFFSYFRGVEVTDNALVNVYPVGEDYYACTETNFITKINPETLETIKQVDLCNYVSVNGATAHPHIENDGTVYNIGNCFGKNFSIAYNIVKIPPLQADKEDPISKSEIVVQFPCSDRFKPSYVHSFGLTPNYIVFVETPVKINLFKFLSSWSLWGANYMDCFESNETMGVWLHIADKKRKKYLNNKYRTSPFNLFHHINTYEDNGFLIVDLCCWKGFEFVYNYLYLANLRENWEEVKKNARKAPQPEVRRYVLPLNIDKADTGKNLVTLPNTTATAILCSDETIWLEPEVLFSGPRQAFEFPQINYQKYCGKPYTYAYGLGLNHFVPDRLCKLNVKTKETWVWQEPDSYPSEPIFVSHPDALEEDDGVVLSVVVSPGAGQKPAYLLILNAKDLSEVARAEVEINIPVTFHGLFKKS

SEQ ID NO: 61459 - protein, 317 aa, Homo sapiens
MSEGVGTFRMVPEEEQELRAQLEQLTTKDHGPVFGPCSQLPRHTLQKAKDELNEREETREEAVRELQEMVQAQAASGEELAVAVAERVQEKDSGFFLRFIRARKFNVGRAYELLRGYVNFRLQYPELFDSLSPEAVRCTIEAGYPGVLSSRDKYGRVVMLFNIENWQSQEITFDEILQAYCFILEKLLENEETQINGFCIIENFKGFTMQQAASLRTSDLRKMVDMLQDSFPARFKAIHFIHQPWYFTTTYNVVKPFLKSKLLERVFVHGDDLSGFYQEIDENILPSDFGGTLPKYDGKAVAEQLFGPQAQAENTAF

SEQ ID NO: 61460 - protein, 2156 aa, Homo sapiens
MSDTPSTGFSIIHPTSSEGQVPPPRHLSLTHPVVAKRISFYKSGDPQFGGVRVVVNPRSFKSFDALLDNLSRKVPLPFGVRNISTPRGRHSITRLEELEDGESYLCSHGRKVQPVDLDKARRRPRPWLSSRAISAHSPPHPVAVAAPGMPRPPRSLVVFRNGDPKTRRAVLLSRRVTQSFEAFLQHLTEVMQRPVVKLYATDGRRVPSLQAVILSSGAVVAAGREPFKPGNYDIQKYLLPARLPGISQRVYPKGNAKSESRKISTHMSSSSRSQIYSVSSEKTHNNDCYLDYSFVPEKYLALEKNDSQNLPIYPSEDDIEKSIIFNQDGTMTVEMKVRFRIKEEETIKWTTTVSKTGPSNNDEKSEMSFPGRTESRSSGLKLAACSFSADVSPMERSSNQEGSLAEEINIQMTDQVAETCSSASWENATVDTDIIQGTQDQAKHRFYRPPTPGLRRVRQKKSVIGSVTLVSETEVQEKMIGQFSYSEERESGENKSEYHMFTHSCSKMSSVSNKPVLVQINNNDQMEESSLERKKENSLLKSSAISAGVIEITSQKMLEMSHNNGLPSTISNNSIVEEDVVDCVVLDNKTGIKNFKTYGNTNDRFSPISADATHFSSNNSGTDKNISEAPASEASSTVTARIDRLINEFAQCGLTKLPKNEKKILSSVASKKKKKSRQQAINSRYQDGQLATKGILNKNERINTKGRITKEMIVQDSDSPLKGGILCEEDLQKSDTVIESNTFCSKSNLNSTISKNFHRNKLNTTQNSKVQGLLTKRKSRSLNKISLGAPKKREIGQRDKVFPHNESKYCKSTFENKSLFHVFNILEQKPKDFYAPQSQAEVASGYLRGMAKKSLVSKVTDSHITLKSQKKRKGDKVKASAILSKQHATTRANSLASLKKPDFPEAIAHHSIQNYIQSWLQNINPYPTLKPIKSAPVCRNETSVVNCSNNSFSGNDPHTNSGKISNFVMESNKHITKIAGLTGDNLCKEGDKSFIANDTGEEDLHETQVGSLNDAYLVPLHEHCTLSQSAINDHNTKSHIAAEKSGPEKKLVYQEINLARKRQSVEAAIQVDPIEEETPKDLLPVLMLHQLQASVPGIHKTQNGVVQMPGSLAGVPFHSAICNSSTNLLLAWLLVLNLKGSMNSFCQVDAHKATNKSSETLALLEILKHIAITEEADDLKAAVANLVESTTSHFGLSEKEQDMVPIDLSANCSTVNIQSVPKCSENERTQGISSLDGGCSASEACAPEVCVLEVTCSPCEMCTVNKAYSPKETCNPSDTFFPSDGYGVDQTSMNKACFLGEVCSLTDTVFSDKACAQKENHTYEGACPIDETYVPVNVCNTIDFLNSKENTYTDNLDSTEELERGDDIQKDLNILTDPEYKNGFNTLVSHQNVSNLSSCGLCLSEKEAELDKKHSSLDDFENCSLRKFQDENAYTSFDMEEPRTSEEPGSITNSMTSSERNISELESFEELENHDTDIFNTVVNGGEQATEELIQEEVEASKTLELIDISSKNIMEEKRMNGIIYEIISKRLATPPSLDFCYDSKQNSEKETNEGETKMVKMMVKTMETGSYSESSPDLKKCIKSPVTSDWSDYRPDSDSEQPYKTSSDDPNDSGELTQEKEYNIGFVKRAIEKLYGKADIIKPSFFPGSTRKSQVCPYNSVEFQCSRKASLYDSEGQSFGSSEQVSSSSSMLQEFQEERQDKCDVSAVRDNYCRGDIVEPGTKQNDDSRILTDIEEGVLIDKGKWLLKENHLLRMSSENPGMCGNADTTSVDTLLDNNSSEVPYSHFGNLAPGPTMDELSSSELEELTQPLELKCNYFNMPHGSDSEPFHEDLLDVRNETCAKERIANHHTEEKGSHQSERVCTSVTHSFISAGNKVYPVSDDAIKNQPLPGSNMIHGTLQEADSLDKLYALCGQHCPILTVIIQPMNEEDRGFAYRKESDIENFLGFYLWMKIHPYLLQTDKNVFREENNKASMRQNLIDNAIGDIFDQFYFSNTFDLMGKRRKQKRINFLGLEEEGNLKKFQPDLKERFCMNFLHTSLLVVGNVDSNTQDLSGQTNEIFKAVDENNNLLNNRFQGSRTNLNQVVRENINCHYFFEMLGQACLLDICQVETSLNISNRNILELCMFEGENLFIWEEEDILNLTDLESSREQEDL

SEQ ID NO: 61461 - protein, 916 aa, Homo sapiens
MQRPVVKLYATDGRRVPSLQAVILSSGAVVAAGREPFKPGNYDIQKYLLPARLPGISQRVYPKGNAKSESRKSSNWKVFIITSDLPDAGTSSQIYIILYGQHRSSAPIYLYGTDGARFQVGHEDIFTITVGDIGALFKIRIGHTNSGSSPSWHCKEIQLHNMNSGKQFYVPVQRWLARDQEDGEICREFPLLSKGQPVLPVTIYEVNVATGELWNAGTVANVYISIHGEKGDTGSRQLFRSKSSFNFLRGQTDTFFLEAVHLGDLCKIVIGHDGLGPGNGWFLDDVVIKDPTTNYEYAFFCHRWLDQGEDDCKIVRELYARDNSIFSARQKLELKRKETWTAESWKFTKGNTLQFYNKLTGGFVRLHPDGTVDAIGEKTDKYGVFDVIFNKRNICIFQSHEMRHLSLALDNGIVTGMVSGEATTELRVLYQPNRCALLESALVPGHTVVFDRHGKIADASSAGYANLSKEFVIFVKGVFLNSAVVLLATSLCQALCLQPDGSCTGVGSQSEKSYWKVHKISSGICMFESVKNAQMYLRIKDGRCDGTGTGDVDCHFKIKKNLKNASISLESTKSPGLFVGLQSDGQAKPMIYTKDENVCFYPQVIQFGRENPMGMSATPSQEEEKIHESKKQKKIPPESEARSPLPSSTAKEIRHFQSSETLLSEDEWKVLVLTGNTGTQANVTLWVYGDKGVTGPISLRKDSSEQLFLPGHEDEFQVEIRNTGNIYKIRIGHDGTSEQPEWNLQRVTMQHMKSKKILDFAANVWLSRIQADGDVVCELPVVKGGQAIFPLVRYQVDVYTGQLKHAETESEVFLCLFGERGDSGLRQLYKSNMQVKFQRGQIDKFQVAAVSLGKLQKVLLRCEASDKSQYWYCEQVIVREPGTTSESIFTCQRWLPFMSQGIIHSEIELYLQGEDY

SEQ ID NO: 61462 - protein, 2400 aa, Homo sapiens
MNSTPRNAQAPSHRECFLPSVARTPSVTKVTPAKKITFLKRGDPRFAGVRLAVHQRAFKTFSALMDELSQRVPLSFGVRSVTTPRGLHSLSALEQLEDGGCYLCSDKKPPKTPSGPGRPQERNPTAQQLRDVEGQREAPGTSSSRKSLKTPRRILLIKNMDPRLQQTVVLSHRNTRNLAAFLGKASDLLRFPVKQLYTTSGKKVDSLQALLHSPSVLVCAGHEAFRTPAMKNARRSEAETLSGLTSRNKNGSWGPKTKPSVIHSRSPPGSTPRLPERPGPSNPPVGPAPGRHPQDTPAQSGPLVAGDDMKKKVRMNEDGSLSVEMKVRFHLVGEDTLLWSRRMGRASALTAASGEDPVLGEVDPLCCVWEGYPWGFSEPGVWGPRPCRVGCREVFGRGGQPGPKYEIWTNPLHASQGERVAARKRWGLAQHVRCSGLWGHGTAGRERCSQDSASPASSTGLPEGSEPESSCCPRTPEDGVDSASPSAQIGAERKAGGSLGEDPGLCIDGAGLGGPEQGGRLTPRARSEEGASSDSSASTGSHEGSSEWGGRPQGCPGKARAETSQQEASEGGDPASPALSLSSLRSDDLQAETQGQGTEQATGAAVTREPLVLGLSCSWDSEGASSTPSTCTSSQQGQRRHRSRASAMSSPSSPGLGRVAPRGHPRHSHYRKDTHSPLDSSVTKQVPRPPERRRACQDGSVPRYSGSSSSTRTQASGNLRPPSSGSLPSQDLLGTSSATVTPAVHSDFVSGVSPHNAPSAGWAGDAGSRTCSPAPIPPHTSDSCSKSGAASLGEEARDTPQPSSPLVLQVGRPEQGAVGPHRSHCCSQPGTQPAQEAQRGPSPEASWLCGRYCPTPPRGRPCPQRRSSSCGSTGSSHQSTARGPGGSPQEGTRQPGPTPSPGPNSGASRRSSASQGAGSRGLSEEKTLRSGGGPQGQEEASGVSPSSLPRSSPEAVVREWLDNIPEEPILMTYELADETTGAAGGGLRGPEVDPGDDHSLEGLGEPAQAGQQSLEGDPGQDPEPEGALLGSSDTGPQSGEGVPQGAAPEGVSEAPAEAGADREAPAGCRVSLRALPGRVSASTQIMRALMGSKQGRPSSVPEVSRPMARRLSCSAGALITCLASLQLFEEDLGSPASKVRFKDSPRYQELLSISKDLWPGCDVGEDQLDSGLWELTWSQALPDLGSHAMTENFTPTSSSGVDISSGSGGSGESSVPCAMDGTLVTQGTELPLKTSNQRPDSRTYESPGDLENQQQCCFPTFLNARACACATNEDEAERDSEEQRASSNLEQLAENTVQEEVQLEETKEGTEGEGLQEEAVQLEETKTEEGLQEEGVQLEETKETEGEGQQEEEAQLEEIEETGGEGLQEEGVQLEEVKEGPEGGLQGEALEEGLKEEGLPEEGSVHGQELSEASSPDGKGSQEDDPVQEEEAGRASASAEPCPAEGTEEPTEPPSHLSETDPSASERQSGSQLEPGLEKPPGATMMGQEHTQAQPTQGAAERSSSVACSAALDCDPIWVSVLLKKTEKAFLAHLASAVAELRARWGLQDNDLLDQMAAELQQDVAQRLQDSTKRELQKLQGRAGRMVLEPPREALTGELLLQTQQRRHRLRGLRNLSAFSERTLGLGPLSFTLEDEPALSTALGSQLGEEAEGEEFCPCEACVRKKVSPMSPKATMGATRGPIKEAFDLQQILQRKRGEHTDGEAAEVAPGKTHTDPTSTRTVQGAEGGLGPGLSQGPGVDEGEDGEGSQRLNRDKDPKLGEAEGDAMAQEREGKTHNSETSAGSELGEAEQEGEGISERGETGGQGSGHEDNLQGEAAAGGDQDPGQSDGAEGIEAPEAEGEAQPESEGVEAPEAEGDAQEAEGEAQPESEDVEAPEAEGEAQPESEDVETPEAEWEVQPESEGAEAPEAEKEAQPETESVEALETEGEDEPESEGAEAQEAEEAAQEAEGQTQPESEVIESQEAEEEAQPESEDVEALEVEVETQEAEGEAQPESEDVEAPEAEGEMQEAEEEAQPESDGVEAQPKSEGEEAQEVEGETQKTEGDAQPESDGVEAPEAEEEAQEAEGEVQEAEGEAHPESEDVDAQEAEGEAQPESEGVEAPEAEGEAQKAEGIEAPETEGEAQPESEGIEAPEAEGEAQPESEGVEAQDAEGEAQPESEGIEAQEAEEEAQPELEGVEAPEAEGEAQPESEGIEAPEAEGEAQPELEGVEAPEAEEEAQPEPEGVETPEAEGEAQPESEGETQGEKKGSPQVSLGDGQSEEASESSSPVPEDRPTPPPSPGGDTPHQRPGSQTGPSSSRASSWGNCWQKDSENDHVLGDTRSPDAKSTGTPHAERKATRMYPESSTSEQEEAPLGSRTPEQGASEGYDLQEDQALGSLAPTEAVGRADGFGQDDLDF

SEQ ID NO: 61463 - protein, 350 aa, Homo sapiens
MGCFFSKRRKADKESRPENEEERPKQYSWDQREKVDPKDYMFSGLKDETVGRLPGTVAGQQFLIQDCENCNIYIFDHSATVTIDDCTNCIIFLGPVKGSVFFRNCRDCKCTLACQQFRVRDCRKLEVFLCCATQPIIESSSNIKFGCFQWYYPELAFQFKDAGLSIFNNTWSNIHDFTPVSGELNWSLLPEDAVVQDYVPIPTTEELKAVRVSTEANRSIVPISRGQRQKSSDESCLVVLFAGDYTIANARKLIDEMVGKGFFLVQTKEVSMKAEDAQRVFREKAPDFLPLLNKGPVIALEFNGDGAVEVCQLIVNEIFNGTKMFVSESKETASGDVDSFYNFADIQMGI

SEQ ID NO: 61464 - protein, 221 aa, Homo sapiens
MSSRPGREDVGAAGARRPREPPEQELQRRREQKRRRHDAQQLQQLKHLESFYEKPPPGLIKEDETKPEDCIPDVPGNEHAREFLAHAPTKGLWMPLGKEVKVMQCWRCKRYGHRTGDKECPFFIKGNQKLEQFRVAHEDPMYDIIRDNKRHEKDVRIQQLKQLLEDSTSDEDRSSSSSSEGKEKHKKKKKKEKHKKRKKEKKKKKKRKHKSSKSNEGSDSE

SEQ ID NO: 61465 - protein, 753 aa, Homo sapiens
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVEIPEEKEGAEDSKGNGIEEQEVEANEENVKVHGGRKEKTEILSDDLTDKAEDHEFSKTEELKLEDVDEEINAENVESKKKTVGDDESVPTGYHSKTEGAERTNDDSSAETIEKKEKANLEERAICEYNENPKGYMLDDADSSSLEILENSETTPSKDMKKTKKIFLFKRVPSINQKIVKNNNEPLPEIKSIGDQIILKSDNKDADQNHMSQNHQNIPPTNTERRSKSCTIL

SEQ ID NO: 61466 - protein, 815 aa, Homo sapiens
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVEIPEEKEGAEDSKGNGIEEQEVEANEENVKVHGGRKEKTEILSDDLTDKAEDHEFSKTEELKLEDVDEEINAENVESKKKTVGDDESVPTGYHSKTEGAERTNDDSSAETIEKKEKANLEERAICEYNENPKGYMLDDADSSSLEILENSETTPSKDMKKTKKIFLFKRVPSINQKIVKNNNEPLPEIKSIGDQIILKSDNKDADQNHMSQNHQNIPPTNTERRSKSCTIL

SEQ ID NO: 61467 - protein, 480 aa, Homo sapiens
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDTHHEPEFQ

SEQ ID NO: 61468 - protein, 1020 aa, Homo sapiens
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVGNDTGQVGPQADTDGEGLQKEVYRHENNNGVDQLDAKEIEKESDGGHSQKESEAEEIDSEKETKLAEIAGMKDLREREKSTKKMSPFFGNLPDRGMNTESEENKDFVKKRESCKQDVIFDSERESVEKPDSYMEGASESQQGIADGFQQPEAIEFSSGEKEDDEVETDQNIRYGRKLIEQGNEKETKPIISKSMAKYDFKCDRLSEIPEEKEGAEDSKGNGIEEQEVEANEENVKVHGGRKEKTEILSDDLTDKAEDHEFSKTEELKLEDVDEEINAENVESKKKTVGDDESVPTGYHSKTEGAERTNDDSSAETIEKKEKANLEERAICEYNENPKGYMLDDADSSSLEILENSETTPSKDMKKTKKIFLFKRVPSINQKIVKNNNEPLPEIKSIGDQIILKSDNKDADQNHMSQNHQNIPPTNTERRSKSCTIL

SEQ ID NO: 61469 - protein, 646 aa, Homo sapiens
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVEIPEEKEGAEDSKGNGIEEQEVEANEENVKVHGGRKEKTEILSDDLTDKAEYSASHSQIVSV

SEQ ID NO: 61470 - protein, 1152 aa, Homo sapiens
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVEIPEEKEGAEDSKGNGIEEQEVEANEENVKVHGGRKEKTEILSDDLTDKAEVSEGKAKSVGEAEDGPEGRGDGTCEEGSSGAEHWQDEEREKGEKDKGRGEMERPGEGEKELAEKEEWKKRDGEEQEQKEREQGHQKERNQEMEEGGEEEHGEGEEEEGDREEEEEKEGEGKEEGEGEEVEGEREKEEGERKKEERAGKEEKGEEEGDQGEGEEEETEGRGEEKEEGGEVEGGEVEEGKGEREEEEEEGEGEEEEGEGEEEEGEGEEEEGEGKGEEEGEEGEGEEEGEEGEGEGEEEEGEGEGEEEGEGEGEEEEGEGEGEEEGEGEGEEEEGEGKGEEEGEEGEGEGEEEEGEGEGEDGEGEGEEEEGEWEGEEEEGEGEGEEEGEGEGEEGEGEGEEEEGEGEGEEEEGEEEGEEEGEGEEEGEGEGEEEEEGEVEGEVEGEEGEGEGEEEEGEEEGEEREKEGEGEENRRNREEEEEEEGKYQETGEEENERQDGEEYKKVSKIKGSVKYGKHKTYQKKSVTNTQGNGKEQRSKMPVQSKRLLKNGPSGSKKFWNNVLPHYLELK

SEQ ID NO: 61471 - protein, 1286 aa, Homo sapiens
MSHLVDPTSGDLPVRDIDAIPLVLPASKGKNMKTQPPLSRMNREELEDSFFRLREDHMLVKELSWKQQDEIKRLRTTLLRLTAAGRDLRVAEEAAPLSETARRGQKAGWRQRLSMHQRPQMHRLQGHFHCVGPASPRRAQPRVQVGHRQLHTAGAPVPEKPKRGPRDRLSYTAPPSFKEHATNENRGEVASKPSELVSGSNSIISFSSVISMAKPIGLCMPNSAHIMASNTMQVEEPPKSPEKMWPKDENFEQRSSLECAQKAAELRASIKEKVELIRLKKLLHERNASLVMTKAQLTEVQEACTFLLTQNQGILSAAHEALLKQVNELRAELKEESKKAVSLKSQLEDVSILQMTLKEFQERVEDLEKERKLLNDNYDKLLESMLDSSDSSSQPHWSNELIAEQLQQQVSQLQDQLDAELEDKRKVLLELSREKAQNEDLKLEVTNILQKHKQEVELLQNAATISQPPDRQSEPATHPAVLQENTQIEPSEPKNQEEKKLSQVLNELQVSHAETTLELEKTRDMLILQRKINVCYQEELEAMMTKADNDNRDHKEKLERLTRLLDLKNNRIKQLEGILRSHDLPTSEQLKDVAYGTRPLSLCLETLPAHGDEDKVDISLLHQGENLFELHIHQAFLTSAALAQAGDTQPTTFCTYSFYDFETHCTPLSVGPQPLYDFTSQYVMETDSLFLHYLQEASARLDIHQAMASEHSTLAAGWICFDRVLETVEKVHGLATLIGAGGEEFGVLEYWMRLRFPIKPSLQACNKRKKAQVYLSTDVLGGRKAQEEEFRSESWEPQNELWIEITKCCGLRSRWLGTQPSPYAVYRFFTFSDHDTAIIPASNNPYFRDQARFPVLVTSDLDHYLRREALSIHVFDDEDLEPGSYLGRARVPLLPLAKNESIKGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 61472 - protein, 645 aa, Homo sapiens
MLLMAPDRCRYVWKHCQPMEMRIKWIFLCCIRPLYDFTSQYVMETDSLFLHYLQEASARLDIHQAMASEHSTLAAGWICFDRVLETVEKVHGLATLIGAGGEEFGVLEYWMRLRFPIKPSLQACNKRKKAQVYLSTDVLGGRKAQEEEFRSESWEPQNELWIEITKCCGLRSRWLGTQPSPYAVYRFFTFSDHDTAIIPASNNPYFRDQARFPVLVTSDLDHYLRREALSIHVFDDEDLEPGSYLGRARVPLLPLAKNESIKGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 61473 - protein, 612 aa, Homo sapiens
MLKLDNKDVISHPLGYPSESLLSIASMLDSSDSSSQPHWSNELIAEQLQQQVSQLQDQLDAELEDKRKVLLELSREKAQNEDLKLEVTNILQKHKQEVELLQNAATISQPPDRQSEPATHPAVLQENTQIEPSEPKNQEEKKLSQVLNELQVSHAETTLELEKTRDMLILQRKINVCYQEELEAMMTKADNDNRDHKEKLERLTRLLDLKNNRIKQLEGILRSHDLPTSGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 61474 - protein, 1286 aa, Homo sapiens
MSHLVDPTSGDLPVRDIDAIPLVLPASKGKNMKTQPPLSRMNREELEDSFFRLREDHMLVKELSWKQQDEIKRLRTTLLRLTAAGRDLRVAEEAAPLSETARRGQKAGWRQRLSMHQRPQMHRLQGHFHCVGPASPRRAQPRVQVGHRQLHTAGAPVPEKPKRGPRDRLSYTAPPSFKEHATNENRGEVASKPSELVSGSNSIISFSSVISMAKPIGLCMPNSAHIMASNTMQVEEPPKSPEKMWPKDENFEQRSSLECAQKAAELRASIKEKVELIRLKKLLHERNASLVMTKAQLTEVQEAYETLLQKNQGILSAAHEALLKQVNELRAELKEESKKAVSLKSQLEDVSILQMTLKEFQERVEDLEKERKLLNDNYDKLLESMLDSSDSSSQPHWSNELIAEQLQQQVSQLQDQLDAELEDKRKVLLELSREKAQNEDLKLEVTNILQKHKQEVELLQNAATISQPPDRQSEPATHPAVLQENTQIEPSEPKNQEEKKLSQVLNELQVSHAETTLELEKTRDMLILQRKINVCYQEELEAMMTKADNDNRDHKEKLERLTRLLDLKNNRIKQLEGILRSHDLPTSEQLKDVAYGTRPLSLCLETLPAHGDEDKVDISLLHQGENLFELHIHQAFLTSAALAQAGDTQPTTFCTYSFYDFETHCTPLSVGPQPLYDFTSQYVMETDSLFLHYLQEASARLDIHQAMASEHSTLAAGWICFDRVLETVEKVHGLATLIGAGGEEFGVLEYWMRLRFPIKPSLQACNKRKKAQVYLSTDVLGGRKAQEEEFRSESWEPQNELWIEITKCCGLRSRWLGTQPSPYAVYRFFTFSDHDTAIIPASNNPYFRDQARFPVLVTSDLDHYLRREALSIHVFDDEDLEPGSYLGRARVPLLPLAKNESIKGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 61475 - protein, 538 aa, Homo sapiens
MNLELLESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKGKEKDSPFKPKLYKGDRGLPLEGSAKGKVQAELSQPLTAGGAISELL

SEQ ID NO: 61476 - protein, 500 aa, Homo sapiens
MNLELLESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKAGGAISELL

SEQ ID NO: 61477 - protein, 1792 aa, Homo sapiens
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAIDDSSASISLAQLTKTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEEEKKKSKLDEFTNDFAKELMEYKKIQKERRRSFSRSKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 61478 - protein, 1758 aa, Homo sapiens
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAIDDSSASISLAQLTKTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEESKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 61479 - protein, 952 aa, Homo sapiens
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAIDDSSASISLAQLTKTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 61480 - protein, 118 aa, Homo sapiens
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAVCKNTISHFFYTLLLPL

SEQ ID NO: 61481 - protein, 469 aa, Homo sapiens
MAAEAGVVGAGASPDGDWRDQACGLLLHVHLSSRLGRAAPVRTGRHLRTVFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 61482 - protein, 425 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 61483 - protein, 416 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 61484 - protein, 186 aa, Homo sapiens
MASPSKAVIVPGNGGGDVTTHGWYGWVKKELEKIPGFQCLAKNMPDPITARESIWLPFMETELHCDEKTIIIGHSSGAIAAMRYAETHRVYAIVLVSAYTSDLGDENERASGYFTRPWQWEKIKANCPYIVQFGSTDDPFLPWKEQQEVADRLETKLHKFTDCGHFQNTEFHELITVVKSLLKVPA

SEQ ID NO: 61485 - protein, 172 aa, Homo sapiens
MASPSKAVIVPGNGGGDVTTHGWYGWVKKELEKIPGFQCLAKNMPDPITARESIWLPFMETELHCDEKTIIIGHSSGAIAAMRYAETHRVYAIVLVSAYTSDLGDENERASGYFTRPWQWEKIKANCPYIVQFGSTDDPFLPWKEQQEVADWKPNCTNSLTVATFRTQSFMN

SEQ ID NO: 61486 - protein, 246 aa, Homo sapiens
MAAAAIPALLLCLPLLFLLFGWSRARRDDPHSLCYDITVIPKFRPGPRWCAVQGQVDEKTFLHYDCGNKTVTPVSPLGKKLNVTMAWKAQNPVLREVVDILTEQLLDIQLENYTPKEPLTLQARMSCEQKAEGHSSGSWQFSIDGQTFLLFDSEKRMWTTVHPGARKMKEKWENDKDVAMSFHYISMGDCIGWLEDFLMGMDSTLEPSAGAPLAMSSGTTQLRATATTLILCCLLIILPCFILPGI

SEQ ID NO: 61487 - protein, 246 aa, Homo sapiens; identical to SEQ ID NO: 61486

SEQ ID NO: 61488 - protein, 1640 aa, Homo sapiens
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGTHFPQHSQSFPTSSTYSSSVQGGGQGAHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSVDTQAGNCKPLQKDKLPENLLSDLSLQSLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWFESSLSHMKPGEEGPDGERAPGDSTTSDASLAQKPNKPAVPEAPIAKKEPVPRGKSLRSRRVHRGLPEAEDSPCRAPVLPKDLLLPESCTGPPQGQMEGAGAPGRGASEGLPRMCTRSLTALSEPRTPGPPGLTTTPAPPDKLGGKQRAAFKSGKRVGKPSPKAASSPSNPAALPVASDSSPMGSKTKETDSPSTPGKDQRSMILRSRTKTQEIFHSKRRRPSEGRLPNCRATKKLLDNSHLPATFKVSSSPQKEGRVSQRARVPKPGAGSKLSDRPLHALKRKSAFMAPVPTKKRNLVLRSRSSSSSNASGNGGDGKEERPEGSPTLFKRMSSPKKAKPTKGNGEPATKLPPPETPDACLKLASRAAFQGAMKTKVLPPRKGRGLKLEAIVQKITSPSLKKFACKAPGASPGNPLSPSLSDKDRGLKGAGGSPVGVEEGLVNVGTGQKLPTSGADPLCRNPTNRSLKGKLMNSKKLSSTDCFKTEAFTSPEALQPGGTALAPKKRSRKGRAGAHGLSKGPLEKRPYLGPALLLTPRDRASGTQGASEDNSGGGGKKPKMEELGLASQPPEGRPCQPQTRAQKQPGHTNYSSYSKRKRLTRGRAKNTTSSPCKGRAKRRRQQQVLPLDPAEPEIRLKYISSCKRLRSDSRTPAFSPFEPSLGAQNPRSGQNAPPAPADARPLCTTRDRRAYSAREQGQR

SEQ ID NO: 61489 - protein, 1862 aa, Homo sapiens
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGWWAGHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSVDSLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWFESSLSHMKPGEEGPDGERAPGDSTTSDASLAQKPNKPAVPEAPIAKKEPVPRGKSLRSRRVHRGLPEAEDSPCRAPVLPKDLLLPESCTGPPQGQMEGAGAPGRGASEGLPRMCTRSLTALSEPRTPGPPGLTTTPAPPDKLGGKQRAAFKSGKRVGKPSPKAASSPSNPAALPVASDSSPMGSKTKETDSPSTPGKDQRSMILRSRTKTQEIFHSKRRRPSEGRLPNCRATKKLLDNSHLPATFKVSSSPQKEGRVSQRARVPKPGAGSKLSDRPLHALKRKSAFMAPVPTKKRNLVLRSRSSSSSNASGNGGDGKEERPEGSPTLFKRMSSPKKAKPTKGNGEPATKLPPPETPDACLKLASRAAFQGAMKTKVLPPRKGRGLKLEAIVQKITSPSLKKFACKAPGASPGNPLSPSLSDKDRGLKGAGGSPVGVEEGLVNVGTGQKLPTSGADPLCRNPTNRSLKGKLMNNRASGTQGASEDNSGGGGKKPKMEELGLASQPPEGRPCQPQTRAQKQPGHTNYSSYSKRKRLTRGRAKNTTSSPCKGRAKRRRQQQVLPLDPAEPEIRLKYISSCKRLRSDSRTPAFSPFVRVEKRDAFTTICTVVNSPGDAPKPHRKPSSSASSSSSSSSFSLDAAGASLATLPGGSILQPRPSLPLSSTMHLGPVVSKALSTSCLVCCLCQNPANFKDLGDLCGPYYPEHCLPKKKPKLKEKVRPEGTCEEASLPLERTLKGPECAAAATAGKPPRPDGPADPAKQGPLRTSARGLSRRLQSCYCCDGREDGGEEAAPADKGHWVHEACAVWTGGVYLVAGKLFGLQEAMKVAVDMHGGTVALAPGDFSLPGLRFASLFQGPSWCDCPVLATSTPSSWSRCVPAAKKPGPPLGAATKDASTPTTTRVPAMQVRARPGTGGHWSPSKQSRGTLPGHSSPNPGPISLFSFPPLLPQQFFYPSVCLDLCWAMPGTWK

SEQ ID NO: 61490 - protein, 1906 aa, Homo sapiens
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGTHFPQHSQSFPTSSTYSSSVQGGGQGAHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSVDTQAGNCKPLQKDKLPENLLSDLSLQSLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWFESSLSHMKPGEEGPDGERAPGDSTTSDASLAQKPNKPAVPEAPIAKKEPVPRGKSLRSRRVHRGLPEAEDSPCRAPVLPKDLLLPESCTGPPQGQMEGAGAPGRGASEGLPRMCTRSLTALSEPRTPGPPGLTTTPAPPDKLGGKQRAAFKSGKRVGKPSPKAASSPSNPAALPVASDSSPMGSKTKETDSPSTPGKDQRSMILRSRTKTQEIFHSKRRRPSEGRLPNCRATKKLLDNSHLPATFKVSSSPQKEGRVSQRARVPKPGAGSKLSDRPLHALKRKSAFMAPVPTKKRNLVLRSRSSSSSNASGNGGDGKEERPEGSPTLFKRMSSPKKAKPTKGNGEPATKLPPPETPDACLKLASRAAFQGAMKTKVLPPRKGRGLKLEAIVQKITSPSLKKFACKAPGASPGNPLSPSLSDKDRGLKGAGGSPVGVEEGLVNVGTGQKLPTSGADPLCRNPTNRSLKGKLMNSKKLSSTDCFKTEAFTSPEALQPGGTALAPKKRSRKGRAGAHGLSKGPLEKRPYLGPALLLTPRDRASGTQGASEDNSGGGGKKPKMEELGLASQPPEGRPCQPQTRAQKQPGHTNYSSYSKRKRLTRGRAKNTTSSPCKGRAKRRRQQQVLPLDPAEPEIRLKYISSCKRLRSDSRTPAFSPFVRVEKRDAFTTICTVVNSPGDAPKPHRKPSSSASSSSSSSSFSLDAAGASLATLPGGSILQPRPSLPLSSTMHLGPVVSKALSTSCLVCCLCQNPANFKDLGDLCGPYYPEHCLPKKKPKLKEKVRPEGTCEEASLPLERTLKGPECAAAATAGKPPRPDGPADPAKQGPLRTSARGLSRRLQSCYCCDGREDGGEEAAPADKGRKHECSKEAPAEPGGEAQEHWVHEACAVWTGGVYLVAGKLFGLQEAMKVAVDMMCSSCQEAGATIGCCHKGCLHTYHYPCASDAGCIFIEENFSLKCPKHKRLP

SEQ ID NO: 61491 - protein, 966 aa, Homo sapiens
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGTHFPQHSQSFPTSSTYSSSVQGGGQGAHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSVDTQAGNCKPLQKDKLPENLLSDLSLQSLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWFEASLYSVYICIHIHIYNIYEDCKC

SEQ ID NO: 61492 - protein, 942 aa, Homo sapiens
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGTHFPQHSQSFPTSSTYSSSVQGGGQGAHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSVDTQAGNCKPLQKDKLPENLLSDLSLQSLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWF

SEQ ID NO: 61493 - protein, 1993 aa, Homo sapiens
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGTHFPQHSQSFPTSSTYSSSVQGGGQGAHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSVDTQAGNCKPLQKDKLPENLLSDLSLQSLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWFESSLSHMKPGEEGPDGERAPGDSTTSDASLAQKPNKPAVPEAPIAKKEPVPRGKSLRSRRVHRGLPEAEDSPCRAPVLPKDLLLPESCTGPPQGQMEGAGAPGRGASEGLPRMCTRSLTALSEPRTPGPPGLTTTPAPPDKLGGKQRAAFKSGKRVGKPSPKAASSPSNPAALPVASDSSPMGSKTKETDSPSTPGKDQRSMILRSRTKTQEIFHSKRRRPSEGRLPNCRATKKLLDNSHLPATFKVSSSPQKEGRVSQRARVPKPGAGSKLSDRPLHALKRKSAFMAPVPTKKRNLVLRSRSSSSSNASGNGGDGKEERPEGSPTLFKRMSSPKKAKPTKGNGEPATKLPPPETPDACLKLASRAAFQGAMKTKVLPPRKGRGLKLEAIVQKITSPSLKKFACKAPGASPGNPLSPSLSDKDRGLKGAGGSPVGVEEGLVNVGTGQKLPTSGADPLCRNPTNRSLKGKLMNSKKLSSTDCFKTEAFTSPEALQPGGTALAPKKRSRKGRAGAHGLSKGPLEKRPYLGPALLLTPRDRASGTQGASEDNSGGGGKKPKMEELGLASQPPEGRPCQPQTRAQKQPGHTNYSSYSKRKRLTRGRAKNTTSSPCKGRAKRRRQQQVLPLDPAEPEIRLKYISSCKRLRSDSRTPAFSPFVRVEKRDAFTTICTVVNSPGDAPKPHRKPSSSASSSSSSSSFSLDAAGASLATLPGGSILQPRPSLPLSSTMHLGPVVSKALSTSCLVCCLCQNPANFKDLGDLCGPYYPEHCLPKKKPKLKEKVRPEGTCEEASLPLERTLKGPECAAAATAGKPPRPDGPADPAKQGPLRTSARGLSRRLQSCYCCDGREDGGEEAAPADKGRKHECSKEAPAEPGGEAQEHWVHEACAVWTGGVYLVAGKLFGLQEAMKVAVDMHGGTVALAPGDFSLPGLRFASLFQGPSWCDCPVLATSTPSSWSRCVPAAKKPGPPLGAATKDASTPTTTRVPAMQVRARPGTGGHWSPSKQSRGTLPGHSSPNPGPISLFSFPPLLPQQFFYPSVCLDLCWAMPGTWK

SEQ ID NO: 61494 - protein, 980 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKKRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 61495 - protein, 973 aa, Homo sapiens
MVKGKTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKKRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 61496 - protein, 980 aa, Homo sapiens; identical to SEQ ID NO: 61494

SEQ ID NO: 61497 - protein, 980 aa, Homo sapiens; identical to SEQ ID NO: 61494

SEQ ID NO: 61498 - protein, 114 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAES

SEQ ID NO: 61499 - protein, 972 aa, Homo sapiens
MEAKTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKKRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 61500 - protein, 125 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHY

SEQ ID NO: 61501 - protein, 107 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQ

SEQ ID NO: 61502 - protein, 150 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDL

SEQ ID NO: 61503 - protein, 126 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYA

SEQ ID NO: 61504 - protein, 104 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRK

SEQ ID NO: 61505 - protein, 139 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILC

SEQ ID NO: 61506 - protein, 126 aa, Homo sapiens; identical to SEQ ID NO: 61503

SEQ ID NO: 61507 - protein, 983 aa, Homo sapiens
MQPTYLPWLSAKEKKTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKKRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 61508 - protein, 951 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 61509 - protein, 530 aa, Homo sapiens
MDDLQSQNLSMDMTDSPPALANNRLENGMAQLITTEAWNINSTDLVKKALVTVPAPSILNPPAESQSGMALKVAATVLQPLCLGESPVVMPIHMQVEGSSAPELNPNGNATYVMTTQGPVQLPVVLEQHVFQHLNSPLVLPQEAPCSSSTIHNNLFQGAEDPEAQPQLLDLRIPSQPQEPTLPFEAVLQNLFPSQGTLGPPPCQPPPGYAPVPPQPFSSPLSPLVPPATLLVPYPVIVPLPVPVPIPIPIPMPQSSESKFSSSFPKPPSSFGLHPFKGTQTPLEKDELKPFDILQPKEYFQLSRHTVIKMGSENEALDLSMKSVPWLKAGEVSPPIFQEDAALDLSVAAHRKSEPPPETLYDSGASVDSSGHTVMEKLPSGMEISFAPATSHEAPAMMDSHISSSDAATEMLSQPNHPSGEVKAENNIEMVGESQAAKVIVSVEDAVPTIFCGKIKGLSGVSTKNFSFKREDSVLQGYDINSQGEESMGNAEPLRKPIKNRSIKLKKVNSQEIHMLPIKKQRLATFFPRK

SEQ ID NO: 61510 - protein, 530 aa, Homo sapiens; identical to SEQ ID NO: 61509

SEQ ID NO: 61511 - protein, 480 aa, Homo sapiens
MDDLQSQNLSMDMTDSPPALANNRLENGMAQLITTEAWNINSTDLVEGSSAPELNPNGNATYVMTTQGPVQLPVVLEQHVFQHLNSPLVLPQEAPCSSSTIHNNLFQGAEDPEAQPQLLDLRIPSQPQEPTLPFEAVLQNLFPSQGTLGPPPCQPPPGYAPVPPQPFSSPLSPLVPPATLLVPYPVIVPLPVPVPIPIPIPMPQSSESKFSSSFPKPPSSFGLHPFKGTQTPLEKDELKPFDILQPKEYFQLSRHTVIKMGSENEALDLSMKSVPWLKAGEVSPPIFQEDAALDLSVAAHRKSEPPPETLYDSGASVDSSGHTVMEKLPSGMEISFAPATSHEAPAMMDSHISSSDAATEMLSQPNHPSGEVKAENNIEMVGESQAAKVIVSVEDAVPTIFCGKIKGLSGVSTKNFSFKREDSVLQGYDINSQGEESMGNAEPLRKPIKNRSIKLKKVNSQEIHMLPIKKQRLATFFPRK

SEQ ID NO: 61512 - protein, 530 aa, Homo sapiens; identical to SEQ ID NO: 61509

SEQ ID NO: 61513 - protein, 530 aa, Homo sapiens; identical to SEQ ID NO: 61509

SEQ ID NO: 61514 - protein, 294 aa, Homo sapiens
MQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWKTNDDTIDFDYTVLLHELSTQEIIPCRIHLVWYPGKPLKVKYHCQELQTPEEASGTEEGSAVVPTELSNF

SEQ ID NO: 61515 - protein, 228 aa, Homo sapiens
MQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWVRKT

SEQ ID NO: 61516 - protein, 163 aa, Homo sapiens
MRRLLIPLALWLGAVGVGVAELTEAQRRGLQVALEEFHKHPPVQWAFQETSVESAVDTPFPAGIFVRLEFKLQQTSCRKRDWKKPECKVRPNGRKRKCLACIKLGSEDKVLGRLVHCPIETQVLREAEEHQETQCLRVQRAGEDPHSFYFPGQFAFSKALPRS

SEQ ID NO: 61517 - protein, 163 aa, Homo sapiens; identical to SEQ ID NO: 61516

SEQ ID NO: 61518 - protein, 163 aa, Homo sapiens; identical to SEQ ID NO: 61516

SEQ ID NO: 61519 - protein, 164 aa, Homo sapiens
MASPHQEPKPGDLIEIFRLGYEHWALYIGDGYVIHLAPPSEYPGAGSSSVFSVLSNSAEVKRERLEDVVGGCCYRVNNSLDHEYQPRPVEVIISSAKEMVGQKMKYSIVSRNCEHFVTQLRYGKSRCKQVEKAKVEVGVATALGILVVAGCSFAIRRYQKKATA

SEQ ID NO: 61520 - protein, 164 aa, Homo sapiens
MGLPEPKPKPGDLIEIFRLGYEHWALYIGDGYVIHLAPPSEYPGAGSSSVFSVLSNSAEVKRERLEDVVGGCCYRVNNSLDHEYQPRPVEVIISSAKEMVGQKMKYSIVSRNCEHFVTQLRYGKSRCKQVEKAKVEVGVATALGILVVAGCSFAIRRYQKKATA

SEQ ID NO: 61521 - protein, 462 aa, Homo sapiens
MASNSSSCPTPGGGHLNGYPVPPYAFFFPPMLGGLSPPGALTTLQHQLPVSGYSTPSPATIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 61522 - protein, 633 aa, Homo sapiens
MYESVEVGGPTPNPFLVVDFYNQNRACLLPEKGLPAPGPYSTPLRTPLWNGSNHSIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIECAKRTRKPSLPSASWANTLRTTAQNNVSLWTLTSGTSSVNSPKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLPRQAAVAPASAPAPTEAARPPTPRDRPRHMDTALALRPGFSLPFYRPCDPAPALPPPALPGSTGDLPWGTGREEAATPWTEAWALSGLPAPTAWADVRGRGQELSEAPGPGSQDGSWGPRVHQDTPLPSSPHLHHQQTPGLGSPILRTHKPLLPSWGTSTSPLPRLVTEGVGQGRGVPPVHTLPYQPQVLILAGFVFILIFLF

SEQ ID NO: 61523 - protein, 457 aa, Homo sapiens
MYESVEVGGPTPNPFLVVDFYNQNRACLLPEKGLPAPGPYSTPLRTPLWNGSNHSIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 61524 - protein, 478 aa, Homo sapiens
MMSQTMTQAGVSFRHSVRAAQCHTRVPNTWPRATRPYASCRRSPRLRGRWPGSAGQGAGGRAPRAGWRAGDVTGSAIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 61525 - protein, 462 aa, Homo sapiens; identical to SEQ ID NO: 61521

SEQ ID NO: 61526 - protein, 346 aa, Homo sapiens
MGQEILPARSPTLRLGSPTPHLPQELLRASPKGPPGRLQLGGLAVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPAT

SEQ ID NO: 61527 - protein, 365 aa, Homo sapiens
MASNSSSCPTPGGGHLNGYPVPPYAFFFPPMLGGLSPPGALTTLQHQLPVSGYSTPSPATVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 61528 - protein, 382 aa, Homo sapiens
MVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 61529 - protein, 443 aa, Homo sapiens
MYDCMETFAPGPRRLYGAAGPGAGLLRRATGGSCFAGLESFAWPQPASLQSVETQSTSSEEMVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 61530 - protein, 454 aa, Homo sapiens
MATNKERLFAAGALGPGSGYPGAGFPFAFPGALRGSPPFEMLSPSFRGLGQPDLPKEMASLSVETQSTSSEEMVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 61531 - protein, 454 aa, Homo sapiens; identical to SEQ ID NO: 61530

SEQ ID NO: 61532 - protein, 101 aa, Homo sapiens
HHQDEFAKRLPGFTGLSIADQITLLKAACLDILMLRICTRYTPEQDTMTFSDGLTLNRTQMHNAGFGPLTDLVFAFAGQLLPLEMDDTETGLLSAICLICG

SEQ ID NO: 61533 - protein, 432 aa, Homo sapiens
MLALPLPPCWSGAPPGEEGESAAGPWCFQHPVSLQAGSRCTTVWKRLPRVRDGCTGRPGPGPACCAEPPAAPVSPDLNLLPGRNPPACNGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 61534 - protein, 462 aa, Homo sapiens
MDTKHFLPLDFSTQVNSSLTSPTGRGSMAAPSLHPSLGPGIGSPGQLHSPISTLSSPINGMGPPFSVISSPMGPHSMSVPTTPTLGFSTGSPQLSSPMNPVSSSEDIKPPLGLNGVLKVPAHPSGNMASFTKHICAICGDRSSGKHYGVYSCEGCKGFFKRTVRKDLTYTCRDNKDCLIDKRQRNRCQYCRYQKCLAMGMKREAVQEERQRGKDRNENEVESTSSANEDMPVERILEAELAVEPKTETYVEANMGLNPSSPNDPVTNICQAADKQLFTLVEWAKRIPHFSELPLDDQVILLRAGWNELLIASFSHRSIAVKDGILLATGLHVHRNSAHSAGVGAIFDRVLTELVSKMRDMQMDKTELGCLRAIVLFNPDSKGLSNPAEVEALREKVYASLEAYCKHKYPEQPGRFAKLLLRLPALRSIGLKCLEHLFFFKLIGDTPIDTFLMEMLEAPHQMT

SEQ ID NO: 61535 - protein, 365 aa, Homo sapiens
MNPVSSSEDIKPPLGLNGVLKVPAHPSGNMASFTKHICAICGDRSSGKHYGVYSCEGCKGFFKRTVRKDLTYTCRDNKDCLIDKRQRNRCQYCRYQKCLAMGMKREAVQEERQRGKDRNENEVESTSSANEDMPVERILEAELAVEPKTETYVEANMGLNPSSPNDPVTNICQAADKQLFTLVEWAKRIPHFSELPLDDQVILLRAGWNELLIASFSHRSIAVKDGILLATGLHVHRNSAHSAGVGAIFDRVLTELVSKMRDMQMDKTELGCLRAIVLFNPDSKGLSNPAEVEALREKVYASLEAYCKHKYPEQPGRFAKLLLRLPALRSIGLKCLEHLFFFKLIGDTPIDTFLMEMLEAPHQMT

SEQ ID NO: 61536 - protein, 533 aa, Homo sapiens
MSWAARPPFLPQRHAAGQCGPVGVRKEMHCGVASRWRRRRPWLDPAAAAAAAVAGGEQQTPEPEPGEAGRDGMGDSGRDSRSPDSSSPNPLPQGVPPPSPPGPPLPPSTAPSLGGSGAPPPPPMPPPPLGSPFPVISSSMGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSPNDPVTNICQAADKQLFTLVEWAKRIPHFSSLPLDDQVILLRAGWNELLIASFSHRSIDVRDGILLATGLHVHRNSAHSAGVGAIFDRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 61537 - protein, 537 aa, Homo sapiens
MSWAARPPFLPQRHAAGQCGPVGVRKEMHCGVASRWRRRRPWLDPAAAAAAAVAGGEQQTPEPEPGEAGRDGMGDSGRDSRSPDSSSPNPLPQGVPPPSPPGPPLPPSTAPSLGGSGAPPPPPMPPPPLGSPFPVISSSMGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSPNDPVTNICQAADKQLFTLVEWAKRIPHFSSLPLDDQVILLRAGWNELLIASFSHRSIDVRDGILLATGLHVHRNSAHSAGVGAIFDRSLSRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 61538 - protein, 537 aa, Homo sapiens; identical to SEQ ID NO: 61537

SEQ ID NO: 61539 - protein, 533 aa, Homo sapiens; identical to SEQ ID NO: 61536

SEQ ID NO: 61540 - protein, 286 aa, Homo sapiens
MPQGSVGRWGCEKKCIVGSRPGGGGDGPGWIPQRRRRRRWQAENNKPRSRSQGRLDGTGWATAGGINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSVSVGVNPLSFVMGVGGGSLGLFYIPSPSFPLITFLTLLGTGGAAKQGLSNI

SEQ ID NO: 61541 - protein, 533 aa, Homo sapiens; identical to SEQ ID NO: 61536

SEQ ID NO: 61542 - protein, 96 aa, Homo sapiens
  MOD_RES (1)..(1): Any amino acid
XSPNDPVTNICQAADKQLFTLVEWAKRIPHFSSLPLDDQVILLRAGLHVHRNSAHSAGVGAIFDRVLTELVSKMRDMRMDKTELGCLRAIILFNPD

SEQ ID NO: 61543 - protein, 533 aa, Homo sapiens; identical to SEQ ID NO: 61536

SEQ ID NO: 61544 - protein, 96 aa, Homo sapiens; identical to SEQ ID NO: 61542
  MOD_RES (1)..(1): Any amino acid

SEQ ID NO: 61545 - protein, 537 aa, Homo sapiens; identical to SEQ ID NO: 61537

SEQ ID NO: 61546 - protein, 533 aa, Homo sapiens; identical to SEQ ID NO: 61536

SEQ ID NO: 61547 - protein, 533 aa, Homo sapiens; identical to SEQ ID NO: 61536

SEQ ID NO: 61548 - protein, 96 aa, Homo sapiens; identical to SEQ ID NO: 61542
  MOD_RES (1)..(1): Any amino acid

SEQ ID NO: 61549 - protein, 96 aa, Homo sapiens; identical to SEQ ID NO: 61542
  MOD_RES (1)..(1): Any amino acid

SEQ ID NO: 61550 - protein, 537 aa, Homo sapiens; identical to SEQ ID NO: 61537

SEQ ID NO: 61551 - protein, 96 aa, Homo sapiens; identical to SEQ ID NO: 61542
  MOD_RES (1)..(1): Any amino acid

SEQ ID NO: 61552 - protein, 537 aa, Homo sapiens; identical to SEQ ID NO: 61537

SEQ ID NO: 61553 - protein, 537 aa, Homo sapiens; identical to SEQ ID NO: 61537

SEQ ID NO: 61554 - protein, 347 aa, Homo sapiens
MRECGGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSPNDPVTNICQAADKQLFTLVEWAKRIPHFSSLPLDDQVILLRAGWNELLIASFSHRSIDVRDGILLATGLHVHRNSAHSAGVGAIFDRSLSRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 61555 - protein, 392 aa, Homo sapiens
MGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGAPSPNDPVTNICQAADKQLFTLVEWAKRIPHFSSLPLDDQVILLRAGWNELLIASFSHRSIDVRDGILLATGLHVHRNSAHSAGVGAIFDRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 61556 - protein, 389 aa, Homo sapiens
MGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGGSQHISKSPNDPVTNICQAADKQLFTLVEWAKRIPHFSSLPLDDQVILLRAGWNELLIASFSHRSIDVRDGILLATGLHVHRNSAHSAGVGAIFDRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 61557 - protein, 347 aa, Homo sapiens; identical to SEQ ID NO: 61554

SEQ ID NO: 61558 - protein, 392 aa, Homo sapiens; identical to SEQ ID NO: 61555

SEQ ID NO: 61559 - protein, 389 aa, Homo sapiens; identical to SEQ ID NO: 61556

SEQ ID NO: 61560 - protein, 286 aa, Homo sapiens; identical to SEQ ID NO: 61540

SEQ ID NO: 61561 - protein, 389 aa, Homo sapiens; identical to SEQ ID NO: 61556

SEQ ID NO: 61562 - protein, 286 aa, Homo sapiens; identical to SEQ ID NO: 61540

SEQ ID NO: 61563 - protein, 392 aa, Homo sapiens; identical to SEQ ID NO: 61555

SEQ ID NO: 61564 - protein, 347 aa, Homo sapiens; identical to SEQ ID NO: 61554

SEQ ID NO: 61565 - protein, 392 aa, Homo sapiens; identical to SEQ ID NO: 61555

SEQ ID NO: 61566 - protein, 392 aa, Homo sapiens; identical to SEQ ID NO: 61555

SEQ ID NO: 61567 - protein, 286 aa, Homo sapiens; identical to SEQ ID NO: 61540

SEQ ID NO: 61568 - protein, 389 aa, Homo sapiens; identical to SEQ ID NO: 61556

SEQ ID NO: 61569 - protein, 347 aa, Homo sapiens; identical to SEQ ID NO: 61554

SEQ ID NO: 61570 - protein, 389 aa, Homo sapiens; identical to SEQ ID NO: 61556

SEQ ID NO: 61571 - protein, 347 aa, Homo sapiens; identical to SEQ ID NO: 61554

SEQ ID NO: 61572 - protein, 286 aa, Homo sapiens; identical to SEQ ID NO: 61540

SEQ ID NO: 61573 - protein, 463 aa, Homo sapiens
MYGNYSHFMKFPAGYGGSPGHTGSTSMSPSAALSTGKPMDSHPSYTDTPVSAPRTLSAVGTPLNALGSPYRVITSAMGPPSGALAAPPGINLVAPPSSQLNVVNSVSSSEDIKPLPGLPGIGNMNYPSTSPGSLVKHICAICGDRSSGKHYGVYSCEGCKGFFKRTIRKDLIYTCRDNKDCLIDKRQRNRCQYCRYQKCLVMGMKREAVQEERQRSRERAESEAECATSGHEDMPVERILEAELAVEPKTESYGDMNMENSTNDPVTNICHAADKQLFTLVEWAKRIPHFSDLTLEDQVILLRAGWNELLIASFSHRSVSVQDGILLATGLHVHRSSAHSAGVGSIFDRVLTELVSKMKDMQMDKSELGCLRAIVLFNPDAKGLSNPSEVETLREKVYATLEAYTKQKYPEQPGRFAKLLLRLPALRSIGLKCLEHLFFFKLIGDTPIDTFLMEMLETPLQIT

SEQ ID NO: 61574 - protein, 134 aa, Homo sapiens
MTRDQNGTWEMESNENFEGYMKALDIDFATRKIAVRLTQTKVIDQDGDNFKTKTTSTFRNYDVDFTVGVEFDEYTKSLDNRHVKALVTWEGDVLVCVQKGEKENRGWKQWIEGDKLYLELTCGDQVCRQVFKKK

SEQ ID NO: 61575 - protein, 24 aa, Homo sapiens
MTRDQNGTWEMESNENFEGYMKAL

SEQ ID NO: 61576 - protein, 103 aa, Homo sapiens
MTRDQNGTWEMESNENFEGYMKALDIDFATRKIAVRLTQTKVIDQDGDNFKTKTTSTFRNYDVDFTVGVEFDEYTKSLDNRHVKALVTWEGDVLVCVQKGEKE

SEQ ID NO: 61577 - protein, 1247 aa, Homo sapiens
MMREWVLLMSVLLCGLAGPTHLFQPSLVLDMAKVLLDNYCFPENLLGMQEAIQQAIKSHEILSISDPQTLASVLTAGVQSSLNDPRLVISYEPSTPEPPPQVPALTSLSEEELLAWLQRGLRHEVLEGNVGYLRVDSVPGQEVLSMMGEFLVAHVWGNLMGTSALVLDLRHCTGGQVSGIPYIISYLHPGNTILHVDTIYNRPSNTTTEIWTLPQVLGERYGADKDVVVLTSSQTRGVAEDIAHILKQMRRAIVVGERTGGGALDLRKLRIGESDFFFTVPVSRSLGPLGGGSQTWEGSGVLPCVGTPAEQALEKALAILTLRSALPGVVHCLQEVLKDYYTLVDRVPTLLQHLASMDFSTVVSEEDLVTKLNAGLQAASEDPRLLVRAIGPTETPSWPAPDAAAEDSPGVAPELPEDEAIRQALVDSVFQVSVLPGNVGYLRFDSFADASVLGVLAPYVLRQVWEPLQDTEHLIMDLRHNPGGPSSAVPLLLSYFQGPEAGPVHLFTTYDRRTNITQEHFSHMELPGPRYSTQRGVYLLTSHRTATAAEEFAFLMQSLGWATLVGEITAGNLLHTRTVPLLDTPEGSLALTVPVLTFIDNHGEAWLGGGVVPDAIVLAEEALDKAQEVLEFHQSLGALVEGTGHLLEAHYARPEVVGQTSALLRAKLAQGAYRTAVDLESLASQLTADLQEVSGDHRLLVFHSPGELVVEEAPPPPPAVPSPEELTYLIEALFKTEVLPGQLGYLRFDAMAELETVKAVGPQLVRLVWQQLVDTAALVIDLRYNPGSYSTAIPLLCSYFFEAEPRQHLYSVFDRATSKVTEVWTLPQVAGQRYGSHKDLYILMSHTSGSAAEAFAHTMQDLQRATVIGEPTAGGALSVGIYQVGSSPLYASMPTQMAMSATTGKAWDLAGVEPDITVPMSEALSIAQDIVALRAKVPTVLQTAGKLVADNYASAELGAKMATKLSGLQSRYSRVTSEVALAEILGADLQMLSGDPHLKAAHIPENAKDRIPGIVPMQIPSPEVFEELIKFSFHTNVLEDNIGYLRFDMFGDGELLTQVSRLLVEHIWKKIMHTDAMIIDMRFNIGGPTSSIPILCSYFFDEGPPVLLDKIYSRPDDSVSELWTHAQVVGERYGSKKSMVILTSSVTAGTAEEFTYIMKRLGRALVIGEVTSGGCQPPQTYHVDDTNLYLTIPTARSVGASDGSSWEGVGVTPHVVVPAEEALARAKEMLQHNQLRVKRSPGLQDHL

SEQ ID NO: 61578 - protein, 199 aa, Homo sapiens
MNYSKIPAQVDLRRQTERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 61579 - protein, 201 aa, Homo sapiens
MKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 61580 - protein, 201 aa, Homo sapiens; identical to SEQ ID NO: 61579

SEQ ID NO: 61581 - protein, 199 aa, Homo sapiens
MNYSKIPAQVDLRRQAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 61582 - protein, 135 aa, Homo sapiens
MPPNLTGYYRFVSQKNMEDYLQALNISLAVRKIALLLKPDKEIEHQGNHMTVRTLSTFRNYTVQFDVGVEFEEDLRSVDGRKCQTIVTWEEEHLVCVQKGEVPNRGWRHWLEGEMLYLELTARDAVCEQVFRKVR

SEQ ID NO: 61583 - protein, 341 aa, Homo sapiens
MNIVVEFFVVTFKVLWAFVLAAARWLVRPKEKSVAGQVCLITGAGSGLGRLFALEFARRRALLVLWDINTQSNEETAGMVRHIYRDLEAADAAALQAGNGEEEILPHCNLQVFTYTCDVGKRENVYLTAERVRKEVGEVSVLVNNAGVVSGHHLLECPDELIERTMMVNCHAHFWTTKAFLPTMLEINHGHIVTVASSLGLFSTAGVEDYCASKFGVVGFHESLSHELKAAEKDGIKTTLVCPYLVDTGMFRGCRIRKEIEPFLPPLKPDYCVKQAMKAILTDQPMICTPRLMYIVTFMKSILPFEAVVCMYRFLGADKCMYPFIAQRKQATNNNEAKNGI

SEQ ID NO: 61584 - protein, 318 aa, Homo sapiens
MVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 61585 - protein, 305 aa, Homo sapiens
MVELMFPLLLLLLPFLLYMAAPQIRKMLSSGVCTSTVQLPGKVVVVTGANTGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 61586 - protein, 316 aa, Homo sapiens
MLVTLGLLTSFFSFLYMVAPSIRKFFAGGVCRTNVQLPGKVVVITGANTGIGKETARELASRGARVYIACRDVLKGESAASEIRVDTKNSQVLVRKLDLSDTKSIRAFAEGFLAEEKQLHILINNAGVMMCPYSKTADGFETHLGVNHLGHFLLTYLLLERLKVSAPARVVNVSSVAHHIGKIPFHDLQSEKRYSRGFAYCHSKLANVLFTRELAKRLQGTGVTTYAVHPGVVRSELVRHSSLLCLLWRLFSPFVKTAREGAQTSLHCALAEGLEPLSGKYFSDCKRTWVSPRARNNKTAERLWNVSCELLGIRWE

SEQ ID NO: 61587 - protein, 316 aa, Homo sapiens; identical to SEQ ID NO: 61586

SEQ ID NO: 61588 - protein, 316 aa, Homo sapiens; identical to SEQ ID NO: 61586

SEQ ID NO: 61589 - protein, 318 aa, Homo sapiens
MWLPLLLGALLWAVLWLLRDRQSLPASNAFVFITGCDSGFGRLLALQLDQRGFRVLASCLTPSGAEDLQRVASSRLHTTLLDITDPQSVQQAAKWVEMHVKEAGLFGLVNNAGVAGIIGPTPWLTRDDFQRVLNVNTMGPIGVTLALLPLLQQARGRVINITSVLGRLAANGGGYCVSKFGLEAFSDSLRRDVAHFGIRVSIVEPGFFRTPVTNLESLEKTLQACWARLPPATQAHYGGAFLTKYLKMQQRIMNLICDPDLTKVSRCLEHALTARHPRTRYSPGWDAKLLWLPASYLPASLVDAVLTWVLPKPAQAVY

SEQ ID NO: 61590 - protein, 318 aa, Homo sapiens; identical to SEQ ID NO: 61589

SEQ ID NO: 61591 - protein, 311 aa, Homo sapiens
MAAAPRTVLISGCSSGIGLELAVQLAHDPKKRYQVVATMRDLGKKETLEAAAGEALGQTLTVAQLDVCSDESVAQCLSCIQGEVDVLVNNAGMGLVGPLEGLSLAAMQNVFDTNFFGAVRLVKAVLPGMKRRRQGHIVVISSVMGLQGVIFNDVYAASKFALEGFFESLAIQLLQFNIFISLVEPGPVVTEFEGKLLAQVSMAEFPGTDPETLHYFRDLYLPASRKLFCSVGQNPQDVVQAIVNVISSTRPPLRRQTNIRYSPLTTLKTVDSSGSLYVRTTHRLLFRCPRLLNLGLQCLSCGCLPTRVRPR

SEQ ID NO: 61592 - protein, 224 aa, Homo sapiens
MSRKIEGFLLLLLFGYEATLGLSSTEDEGEDPWYQKACKCDCQGGPNALWSAGATSLDCIPECPYHKPLGFESGEVTPDQITCSNPEQYVGWYSSWTANKARLNSQGFGCAWLSKFQDSSQWLQIDLKEIKVISGILTQGRCDIDEWMTKYSVQYRTDERLNWIYYKDQTGNNRVFYGNSDRTSTVQNLLRPPIISRFIRLIPLGWHVRIAIRMELLECVSKCA

SEQ ID NO: 61593 - protein, 1358 aa, Homo sapiens
MIEPSEDSFETMMEHKNPSSKQMESSEGSSNTTEATSGSGVRGEAGPASGPAQEKKEPPSGPLQEMEELPTDLLQDMEEPSSGPRKEIEDPPNDLLQDLEESCNGSHQARGDPLSGASDRMKEASVNPSGAREEQEAHTDLKESGREETPQEQNQTEHSTAELMAMVRSIISLYFRMQDLKEQQRVAEEILIKGINAGQLPAPKHFSGDRREFHEFIVLCQLTLQSYPRMFYNDRLRVGYVINHLSGLALEWAKALLQENSPLIGDFPAFLEAMSEVFEYRQALRVAEEAMFTIRQGGRSATEYIDEFQSLVPILGWPDEVLQAHLCQGLNEEIRHYLFRVPQPDSLDSLIVLILQIEEKLAERRAMLRLPPEARPRNLTWIDSPAPERWMVSSWLPSEVHPDINRAHLFLLLMVRVNPYHSVAVQALVDSGADGNFMDEKFAQEHYVELYEKPYPQPVQSVDGSLIGNEPVWLYTEPLVCIHQNHQESIEFDIVPSPNFSVVLGIRWLRVHAPEVDWIKGRCTFHSPYCLKNCFRPPPPCIALERHGMSLLPGLPHPYSDLADVFNPKEADDETSDQPSSDGSDDLSESEPSELQQAGDSDHSETFYECPSTAPWEPVGARMQERARLQEEYWDLQDMLTNRQDYIQMIPELFDQLHGAEWFTKLELRGTIVEESVNGHRTEDVWKAAFGLELEEMKSYQPFALSPDPIIPQNVIHFILKDMLGFFVLSYGQEVLIYSMSQEEHLHHVRQVLVRFRHHNVYCSLDKSQFHRQTVEFLGFVVTPKGVKLNKNVMTIITGYPTPGSKLSLRNFIEFVFPYRHFVERFSIIAEPLVRQLLSSYQFYWGVEEQEAFECLKRAFRKAPLLHHPKPQNPFYLETGVTGTALHASLIQIDDQTGKRACCAFYSRNISPIEVEYSQAEMKILPIRAAFMVWCRYLENTEEPIMILLNTEDLASLNNDRLTVLLPGHWVFFFSHFNFDVMELPEQDGGRALPPVRNLRWRRAFQRNTAARQTLLLASRGFPRDPSTESGEEENEEQDELNEQILRQELLAMIPIDQILNSFLAHFSMAQIRAVILHFFRGLLYWKNTLALAAILVLLRVRQCLSLRPAPAMRVARPQPQRSLRLILDSSLIAGSSITTAITQLLTQMPALVGANTIPAQELAELFLGPGRWQRNALHSQAHRGLQFTPGFWLTLCEFFGVRVTPQEGHLPALRQNRYLELHVVGDEDVVLREALQDDLQRYRQCGLHDGLQDTSQDKQDNDVQEAPPSHTAATHPPRPRHLMDPQVLEFLGSRLLHIHSADGQLHLLSREQAARALSQFLTLIYRRALPIPAWESQPREQARLEELPDEDEDANLD

SEQ ID NO: 61594 - protein, 3130 aa, Homo sapiens
MFSVRIVTADYYMASPLQGLDTCQSPLTQAPVKKVPVVRVFGATPAGQKTCLHLHGIFPYLYVPYDGYGQQPESYLSQMAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPQSTCELEVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVYKKTVNSRIGKTSRARAQIKKSKAKLANPSIVTKKRNKRNQTNKLVDDGKKKPRAKQKTNEKGTSRKHTTLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQKAQNANTTQDPLSNKHQPNKNISGSLEHNKANKRTRSVTSPRKPRTPRSTKQKEKIPKLLKVDSLNLQNSSQLDNSVSDDSPIFFSDPGFESCYSLEDSLSPEHNYNFDINTIGQTGFCSFYSGSQFVPADQNLPQKFLSDAVQDLFPGQAIEKNEFLSHDNQKCDEDKHHTTDSASWIRSGTLSPEIFEKSTIDSNENRRHNQWKNSFHPLTTRSNSIMDSFCVQQAEDCLSEKSRLNRSSVSKEVFLSLPQPNNSDWIQGHTRKEMGQSLDSANTSFTAILSSPDGELVDVACEDLELYVSRNNDMLTPTPDSSPRSTSSPSQSKNGSFTPRTANILKPLMSPPSREEIMATLLDHDLSETIYQEPFCSNPSDVPEKPREIGGRLLMVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYDPDILLGYEIQMHSWGYLLQRAAALSIDLCRMISRVPDDKIENRFAAERDEYGSYTMSEINIVGRITLNLWRIMRNEVALTNYTFENVSFHVLHQRFPLFTFRVLSDWFDNKTDLYRWKMVDHYVSRVRGNLQMLEQLDLIGKTSEMARLFGIQFLHVLTRGSQYRVESMMLRIAKPMNYIPVTPSVQQRSQMRAPQCVPLIMEPESRFYSNSVLVLDFQSLYPSIVIAYNYCFSTCLGHVENLGKYDEFKFGCTSLRVPPDLLYQVRHDITVSPNGVAFVKPSVRKGVLPRMLEEILKTRFMVKQSMKAYKQDRALSRMLDARQLGLKLIANVTFGYTSANFSGRMPCIEVGDSIVHKARETLERAIKLVNDTKKWGARVVYGDTDSMFVLLKGATKEQSFKIGQEIAEAVTATNPKPVKLKFEKVYLPCVLQTKKRYVGYMYETLDQKDPVFDAKGIETVRRDSCPAVSKILERSLKLLFETRDISLIKQYVQRQCMKLLEGKASIQDFIFAKEYRGSFSYKPGACVPALELTRKMLTYDRRSEPQVGERVPYVIIYGTPGVPLIQLVRRPVEVLQDPTLRLNATYYITKQILPPLARIFSLIGIDVFSWYHELPRIHKATSSSRSEPEGRKGTISQYFTTLHCPVCDDLTQHGICSKCRSQPQHVAVILNQEIRELERQQEQLVKICKNCTGCFDRHIPCVSLNCPVLFKLSRVNRELSKAPYLRQLLDQF

SEQ ID NO: 61595 - protein, 3130 aa, Homo sapiens; identical to SEQ ID NO: 61594

SEQ ID NO: 61596 - protein, 3130 aa, Homo sapiens; identical to SEQ ID NO: 61594

SEQ ID NO: 61597 - protein, 3052 aa, Homo sapiens
MAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPQSTCELEVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVYKKTVNSRIGKTSRARAQIKKSKAKLANPSIVTKKRNKRNQTNKLVDDGKKKPRAKQKTNEKGTSRKHTTLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQKAQNANTTQDPLSNKHQPNKNISGSLEHNKANKRTRSVTSPRKPRTPRSTKQKEKIPKLLKVDSLNLQNSSQLDNSVSDDSPIFFSDPGFESCYSLEDSLSPEHNYNFDINTIGQTGFCSFYSGSQFVPADQNLPQKFLSDAVQDLFPGQAIEKNEFLSHDNQKCDEDKHHTTDSASWIRSGTLSPEIFEKSTIDSNENRRHNQWKNSFHPLTTRSNSIMDSFCVQQAEDCLSEKSRLNRSSVSKEVFLSLPQPNNSDWIQGHTRKEMGQSLDSANTSFTAILSSPDGELVDVACEDLELYVSRNNDMLTPTPDSSPRSTSSPSQSKNGSFTPRTANILKPLMSPPSREEIMATLLDHDLSETIYQEPFCSNPSDVPEKPREIGGRLLMVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYDPDILLGYEIQMHSWGYLLQRAAALSIDLCRMISRVPDDKIENRFAAERDEYGSYTMSEINIVGRITLNLWRIMRNEVALTNYTFENVSFHVLHQRFPLFTFRVLSDWFDNKTDLYRWKMVDHYVSRVRGNLQMLEQLDLIGKTSEMARLFGIQFLHVLTRGSQYRVESMMLRIAKPMNYIPVTPSVQQRSQMRAPQCVPLIMEPESRFYSNSVLVLDFQSLYPSIVIAYNYCFSTCLGHVENLGKYDEFKFGCTSLRVPPDLLYQVRHDITVSPNGVAFVKPSVRKGVLPRMLEEILKTRFMVKQSMKAYKQDRALSRMLDARQLGLKLIANVTFGYTSANFSGRMPCIEVGDSIVHKARETLERAIKLVNDTKKWGARVVYGDTDSMFVLLKGATKEQSFKIGQEIAEAVTATNPKPVKLKFEKVYLPCVLQTKKRYVGYMYETLDQKDPVFDAKGIETVRRDSCPAVSKILERSLKLLFETRDISLIKQYVQRQCMKLLEGKASIQDFIFAKEYRGSFSYKPGACVPALELTRKMLTYDRRSEPQVGERVPYVIIYGTPGVPLIQLVRRPVEVLQDPTLRLNATYYITKQILPPLARIFSLIGIDVFSWYHELPRIHKATSSSRSEPEGRKGTISQYFTTLHCPVCDDLTQHGICSKCRSQPQHVAVILNQEIRELERQQEQLVKICKNCTGCFDRHIPCVSLNCPVLFKLSRVNRELSKAPYLRQLLDQF

SEQ ID NO: 61598 - protein, 762 aa, Homo sapiens
MVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYDPDILLGYEIQMHSWGYLLQRAAALSIDLCRMISRVPDDKIENRFAAERDEYGSYTMSEINIVGRITLNLWRIMRNEVALTNYTFENVSFHVLHQRFPLFTFRVLSDWFDNKTDLYRWKMVDHYVSRVRGNLQMLEQLDLIGKTSEMARLFGIQFLHVLTRGSQYRVESMMLRIAKPMNYIPVTPSVQQRSQMRAPQCVPLIMEPESRFYSNSVLVLDFQSLYPSIVIAYNYCFSTCLGHVENLGKYDEFKFGCTSLRVPPDLLYQVRHDITVSPNGVAFVKIANKCRPEGMA

SEQ ID NO: 61599 - protein, 1221 aa, Homo sapiens
MLRSTGFFRAIDCPYWSGAPGGPCRRPYCHFRHRGARGSGAPGDGGEAPPAAGLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGAPPAPSCKDGAQGKDKTKDKGRGRPVEKPRADKKGPQASSPRRKAERPEGTKKKPSSATPVATSGKGRPDRPARRPSPTSGDSRPAAGRGPPRPLQLPDRKSTKAPSGKLVERKARSLDEGASQDAPKLKKRALSHADLFGDESEDEAAGPGVPSVWPSALPSLSSDSDSDSDSSLGFPEAQGPPKRLKASPPPSPAPSSSSSSSSSTSSAGADVDYSALEKEVDFDSDPMEECLRIFNESTSVKTEDRGRLARQPPKEEKSEEKGLSGLTTLFPGQKRRISHLSKQGQEVEPPRRGPAVPPARPPTAQEVCYLRAQQAQRASASLLQAPARLAEKSPSVHISAPGEKRRIAHIPNPRLAAAPTGAKRTLAASGSQSSNGPEPGGQQLKTRTLSGMASKTTTTIIPKRIAHSPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVIHSTVVDTSVLFPHRLGLPYKRSLRNLMADYLRQIIQDNVDGHSSSEDAGACMHLVIWKVREDAKTKR

SEQ ID NO: 61600 - protein, 337 aa, Homo sapiens
MLPSSTRLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGA

SEQ ID NO: 61601 - protein, 493 aa, Homo sapiens
MGSHSPCAHTPCAPPAPTGAKRTLAASGSQSSNGPEPGGQQLKTRTLSGMASKTTTTIIPKRIAHSPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVIHSTVVDTSVLFPHRLGLPYKRSLRNLMADYLRQIIQDNVDGHSSSEDAGACMHLVIWKVREDAKTKR

SEQ ID NO: 61602 - protein, 237 aa, Homo sapiens
MLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGKSGLTKAVKESTITLQQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKRKIIENGENEKTVS

SEQ ID NO: 61603 - protein, 250 aa, Homo sapiens
MGKAKVPASKRAPSSPVAKPGPVKTLTRKKNKKKKRFWKSKAREVSKKPASGPGAVVRPPKAPEDFSQNWKALQEVPRWTGGRQYLAPRPVEQSTIRKEPRKGQMVILFQNEGTSSIRSGKLRRQPQPHPPREELEVVQKEVAEMLKGRILVGHALHNDLKVLFLDHPKKKIRDTQKYKPFKSQVKSGRPSLRLLSEKILGLQVQQAEHCSIQDAQAAMRLYVMVKKEWESMARDRRPLLTAPDHCSDDA

SEQ ID NO: 61604 - protein, 422 aa, Homo sapiens
MGKAKVPASKRAPSSPVAKPGPVKTLTRKKNKKKKRFWKSKAREVSKKPASGPGAVVRPPKAPEDFSQNWKALQEWLLKQKSQAPEKPLVISQMGSKKKPKIIQQNKKETSPQVKGEEMPAGKDQEASRGSVPSGSKMDRRAPVPRTKASGTEHNKKGTKERTNGDIVPERGDIEHKKRKAKEAAPAPPTEEDIWFDDVDPADIEAAIGPEAAKIARKQLGQSEGSVSLSLVKEQAFGGLTRALALDCEMVGVGPKGEESMAARVSIVNQYGKCVYDKYVKPTEPVTDYRTAVSGIRPENLKQGEELEVVQKEVAEMLKGRILVGHALHNDLKVLFLDHPKKKIRDTQKYKPFKSQVKSGRPSLRLLSEKILGLQVQQAEHCSIQDAQAAMRLYVMVKKEWESMARDRRPLLTAPDHCSDDA

SEQ ID NO: 61605 - protein, 189 aa, Homo sapiens
MGSKKKPKIIQQNKKETSPQVKGEEMPAGKDQEASRGSVPSGSKMDRRAPVPRTKASGTEHNKKGTKERTNGDIVPERGDIEHKKRKAKEAAPAPPTEEDIWFDDVDPADIEAAIGPEAAKIARKQLGQSEGSVSLSLVKEQAFGGLTRALALDCEMVGVGPKGEESMAARVSIVNQYGKCVYDKYVKP

SEQ ID NO: 61606 - protein, 374 aa, Homo sapiens
PVAKPGPVKTLTRKKNKKKKRFWKSKAREVSKKPASGPGAVVRPPKAPEDFSQNWKALQEWLLKQKSQAPEKPLVISQMGSKKKPKIIQQNKKETSPQVKGEEMPAGKDQEASRGSVPSGSKMDRRAPVPRTKASGTEHNKKGTKERTNGDIVPERGDIEHKKRKAKEAAPAPPTEEDIWFDDVDPADIEAAIGPEAAKIARKQLGQSEGSVSLSLVKEQAFGGLTRALALDCEMVGVGPKGEESMAARVSIVNQYGKCVYDKYVKPTEPVTDYRTAVSGIRPENLKQGEELEVVQKEVAEMLKGRILVGHALHNDLKSGRPSLRLLSEKILGLQVQQDSGCPGSNEAVRHGEEGVGEHGPRQAPPADCSRPLQ

SEQ ID NO: 61607 - protein, 233 aa, Homo sapiens
MGKAKVPASKRAPSSPVAKPGPVKTLTRKKNKKKKRFWKSKAREVSKKPASGPGAVVRPPKAPEDFSQNWKALQEVPRWTGGRQYLAPRPVEQSTIRKEPRKGQMVILFQNEGTSSIRSGKLRRQPQPHPPREELEVVQKEVAEMLKGRILVGHALHNDLKVLFLDHPKKKIRDTQKYKPFKSQVKSGRPSLRLLSEKILGLQVQQAEHCSIQDAQAAMRLYVMVKKEWESMA

SEQ ID NO: 61608 - protein, 331 aa, Homo sapiens
MSRARGALCRACLALAAALAALLLLPLPLPRAPAPARTPAPAPRAPPSRPAAPSLRPDDVFIAVKTTRKNHGPRLRLLLRTWISRARQQTFIFTDGDDPELELQGGDRVINTNCSAVRTRQALCCKMSVEYDKFIESGRKWFCHVDDDNYVNARSLLHLLSSFSPSQDVYLGRPSLDHPIEATERVQGGRTVTTVKFWFATGGAGFCLSRGLALKMSPWASLGSFMSTAEQVRLPDDCTVGYIVEGLLGARLLHSPLFHSHLENLQRLPPDTLLQQVTLSHGGPENPHNVVNVAGGFSLHQDPTRFKSIHCLLYPDTDWCPRQKQGAPTSR

SEQ ID NO: 61609 - protein, 290 aa, Homo sapiens
MSRAPPSRPAAPSLRPDDVFIAVKTTRKNHGPRLRLLLRTWISRARQQTFIFTDGDDPELELQGGDRVINTNCSAVRTRQALCCKMSVEYDKFIESGRKWFCHVDDDNYVNARSLLHLLSSFSPSQDVYLGRPSLDHPIEATERVQGGRTVTTVKFWFATGGAGFCLSRGLALKMSPWASLGSFMSTAEQVRLPDDCTVGYIVEGLLGARLLHSPLFHSHLENLQRLPPDTLLQQVTLSHGGPENPHNVVNVAGGFSLHQDPTRFKSIHCLLYPDTDWCPRQKQGAPTSR

SEQ ID NO: 61610 - protein, 541 aa, Homo sapiens
MGSQEVLGHAARLASSGLLLQVLFRLITFVLNAFILRFLSKEIVGVVNVRLTLLYSTTLFLAREAFRRACLSGGTQRDWSQTLNLLWLTVPLGVFWSLFLGWIWLQLLEVPDPNVVPHYATGVVLFGLSAVVELLGEPFWVLAQAHMFVKLKVIAESLSVILKSVLTAFLVLWLPHWGLYIFSLAQLFYTTVLVLCYVIYFTKLLGSPESTKLQTLPVSRITDLLPNITRNGAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLALLAGLTITVFGFAYSQLALDIYGGTMLSSGSGPVLLRSYCLYVLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCEQGWPARLAHIAVGAFCLGATLGTAFLTETKLIHFLRTQLGVPRRTDKMT

SEQ ID NO: 61611 - protein, 502 aa, Homo sapiens
MGSQEVLGHAARLASSGLLLQVLFRLITFVLNAFILRFLSKEIVGVVNVRVPLGVFWSLFLGWIWLQLLEVPDPNVVPHYATGVVLFGLSAVVELLGEPFWVLAQAHMFVKLKVIAESLSVILKSVLTAFLVLWLPHWGLYIFSLAQLFYTTVLVLCYVIYFTKLLGSPESTKLQTLPVSRITDLLPNITRNGAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLALLAGLTITVFGFAYSQLALDIYGGTMLSSGSGPVLLRSYCLYVLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCEQGWPARLAHIAVGAFCLGATLGTAFLTETKLIHFLRTQLGVPRRTDKMT

SEQ ID NO: 61612 - protein, 1435 aa, Homo sapiens
MAQTPDGISCELRGEITRFLWPKEVELLLKTWLPGEGAVQNHVLALLRWRAYLLHTTCLPLRVDCTFSYLEVQAMALQETPPQVTFELESLRELVLEFPGVAALEQLAQHVAAAIKKVFPRSTLGKLFRRPTPASMLARLERSSPSESTDPCSPCGGFLETYEALCDYNGFPFREEIQWDVDTIYHRQGCRHFSLGDFSHLGSRDLALSVAALSYNLWFRCLSCVDMKLSLEVSEQILHMMSQSSHLEELVLETCSLRGDFVRRLAQALAGHSSSGLRELSLAGNLLDDRGMTALSRHLERCPGALRRLSLAQTGLTPRGMRALGRALATNAAFDSTLTHLDLSGNPGALGASEDSGGLYSFLSRPNVLSFLNLAGTDTALDTVRGCSVGGWMTGRADWRAGRGGLGPPAGVANSLPPQLFAAVSRGCCTSLTHLDASRNVFSRTKSRAAPAALQLFLSRARTLRHLGLAGCKLPPDALRALLDGLALNTHLRDLHLDLSACELRSAGAQVIQDLVCDAGAVSSLDLADNGFGSDMVTLVLAIGRSRSLRHVALGRNFNVRCKETLDDVLHRIVQLMQDDDCPLQSLSVAESRLKLGASVLLRALATNPNLTALDISGNAMGDAGAKLLAKALRVNSRLRSVVWDRNHTSALGLLDVAQALEQNHSLKAMPLPLNDVAQAQRSRPELTARAVHQIQACLLRNNRADPASSDHTTRLQPLGLVSDPSEQEVNELCQSVQEHVELLGCGAGPQGEAAVRQAEDAIQNANFSLSILPILYEAGSSPSHHWQLGQKLEGLLRQVGEVCRQDIQDFTQATLDTARSLCPQMLQGSSWREQLEGVLAGSRGLPELLPEQLLQDAFTRLRDMRLSITGTLAESIVAQALAGLSAARDQLVESLAQQATVTMPPALPAPDGGEPSLLEPGELEGLFFPEEKEEEKEKDDSPPQKWPELSHGLHLVPFIHSAAEEAEPEPELAAPGEDAEPQAGPSARGSPSPAAPGPPAGPLPRMDLPLAGQPLRHPTRARPRPRRQHHHRPPPGGPQVPPALPQEGNGLSARVDEGVEEFFSKRLIQQDRLWAPEEDPATEGGATPVPRTLRKKLGTLFAFKKPRSTRGPRTDLETSPGAAPRTRKTTFGDLLRPPTRPSRGEELGGAEGDTSSPDPAGRSRPRYTRDSKAYSMILLPAEEEATLGARPDKRRPLERGETELAPSFEQRVQVMLQRIGVSRGSGGAEGKRKQSKDGEIKKAGSDGDIMDSSTEAPPISIKSRTHSVSADPSCRPGPGSQGPESATWKTLGQQLNAELRSRGWGQQDGPGPPSPGQSPSPCRTSPSPDSLGLPEDPCLGPRNEDGQLRPRPLSAGRRAVSVHEDQLQAPAERPLRLQRSPVLKRRPKLEAPPSPSLGSGLGTEPLPPQPTEPSSPERSPPSPATDQRGGGPNP

SEQ ID NO: 61613 - protein, 444 aa, Homo sapiens
MPPALPAPDGGEPSLLEPGELEGLFFPEEKEEEKEKDDSPPQKWPELSHGLHLVPFIHSAAEEAEPEPELAAPGEDAEPQAGPSARGSPSPAAPGPPAGPLPRMDLPLAGQPLRHPTRARPRPRRQHHHRPPPGGPQVPPALPQEGNGLSARVDEGVEEFFSKRLIQQDRLWAPEEDPATEGGATPVPRTLRKKLGTLFAFKKPRSTRGPRTDLETSPGAAPRTRKTTFGDLLRPPTRPSRGEELGGAEGDTSSPDPAGRSRPRYTRDSKAYSMILLPAEEEATLGARPDKRRPLERGETELAPSFEQRVQVMLQRIGVSRGSGGAEGKRKQSKDGEIKKAGSDGDIMDSSTEAPPISIKSRTHSVSADPSCRPGPGSQGPESATWKTLGQQLNAELRSRGWGQQDGPGPPSPGQSPSPCRTPPQTAWASQRTLAWAPEMKNGP

SEQ ID NO: 61614 - protein, 1372 aa, Homo sapiens
MAQTPDGISCELRGEITRFLWPKEVELLLKTWLPGEGAVQNHVLALLRWRAYLLHTTCLPLRVDCTFSYLEVQAMALQETPPQVTFELESLRELVLEFPGVAALEQLAQHVAAAIKKVFPRSTLGKLFRRPTPASMLARLERSSPSESTDPCSPCGGFLETYEALCDYNGFPFREEIQWDVDTIYHRQGCRHFSLGDFSHLGSRDLALSVAALSYNLWFRCLSCVDMKLSLEVSEQILHMMSQSSHLEELVLETCSLRGDFVRRLAQALAGHSSSGLRELSLAGNLLDDRGMTALSRHLERCPGALRRLSLAQTGLTPRGMRALGRALATNAAFDSTLTHLDLSGNPGALGASEDSGGLYSFLSRPNVLSFLNLAGTDTALDTLFAAVSRGCCTSLTHLDASRNVFSRTKSRAAPAALQLFLSRARTLRHLGLAGCKLPPDALRALLDGLALNTHLRDLHLDLSACELRSAGAQVIQDLVCDAGAVSSLDLADNGFGSDMVTLVLAIGRSRSLRHVALGRNFNVRCKETLDDVLHRIVQLMQDDDCPLQSLSVAESRLKLGASVLLRALATNPNLTALDISGNAMGDAGAKLLAKALRVNSRLRSVVWDRNHTSALGLLDVAQALEQNHSLKAMPLPLNDVAQAQRSRPELTARAVHQIQACLLRNNRADPASSDHTTRLQPLGLVSDPSEQEVNELCQSVQEHVELLGCGAGPQGEAAVRQAEDAIQNANFSLSILPILYEAGSSPSHHWQLGQKLEGLLRQVGEVCRQDIQDFTQATLDTARSLCPQMLQGSSWREQLEGVLAGSRGLPELLPEQLLQDAFTRLRDMRLSITGTLAESIVAQALAGLSAARDQLVESLAQQATVTMPPALPAPDGGEPSLLEPGELEGLFFPEEKEEEKEKDDSPPQKWPELSHGLHLVPFIHSAAEEAEPEPELAAPGEDAEPQAGPSARGSPSPAAPGPPAGPLPRMDLPLAGQPLRHPTRARPRPRRQHHHRPPPGGPQVPPALPQEGNGLSARVDEGVEEFFSKRLIQQDRLWAPEEDPATEGGATPVPRTLRKKLGTLFAFKKPRSTRGPRTDLETSPGAAPRTRKTTFGDLLRPPTRPSRGEELGGAEGDTSSPDPAGRSRPRYTRDSKAYSMILLPAEEEATLGARPDKRRPLERGETELAPSFEQRVQVMLQRIGVSRGSGGAEGKRKQSKDGEIKKAGSDGDIMDSSTEAPPISIKSRTHSVSADPSCRPGPGSQGPESATWKTLGQQLNAELRSRGWGQQDGPGPPSPGQSPSPCRTSPSPDSLGLPEDPCLGPRNEERPLRLQRSPVLKRRPKLEAPPSPSLGSGLGTEPLPPQPTEPSSPERSPPSPATDQRGGGPNP

SEQ ID NO: 61615 - protein, 434 aa, Homo sapiens
MGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYDRTRDLPGRAAAGLPLAPRPLLGALVPLLALLPVFC

SEQ ID NO: 61616 - protein, 450 aa, Homo sapiens
MQPPRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYDRTRDLPGRAAAGLPLAPRPLLGALVPLLALLPVFC

SEQ ID NO: 61617 - protein, 434 aa, Homo sapiens; identical to SEQ ID NO: 61615

SEQ ID NO: 61618 - protein, 341 aa, Homo sapiens
MSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYDRTRDLPGRAAAGLPLAPRPLLGALVPLLALLPVFC

SEQ ID NO: 61619 - protein, 434 aa, Homo sapiens; identical to SEQ ID NO: 61615

SEQ ID NO: 61620 - protein, 458 aa, Homo sapiens
MGGLGPRRAGTSRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYDRTRDLPGRAAAGLPLAPRPLLGALVPLLALLPVFC

SEQ ID NO: 61621 - protein, 478 aa, Homo sapiens
MIRKKRKRSAPPGPCRSHGPRPATAPAPPPSPEPTRPAWTGMGLRAAPSSAAAAAAEVEQRRSPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHECTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 61622 - protein, 437 aa, Homo sapiens
MGLRAAPSSAAAAAAEVEQRRSPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHECTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 61623 - protein, 391 aa, Homo sapiens
MIEVVAELSRGPVFLAGEALECVVTVTNPLPPTATSASSEALAWASAQIHCQFHASESRVALPPPDSSQPDVQPDSQTVFLPHRGERGQCILSTPPKILFCDLRLDPGESKSYSYSEVLPIEGPPSFRGQSVKYVYKLTIGCQRVNSPITLLRVPLRVLVLTGLQDVRFPQDEAVAPSSPFLEEDEGGKKDSWLAELAGERLMAATSCRSLHLYNISDGRGKVGTFGIFKSVYRLGEDVVGTLNLGEGTVACLQFSVSLQTEERVQPEYQRRRGAGGVPSVSHVTHARHQESCLHTTRTSFSLPIPLSSTPGFCTAIVSLKWRLHFEFVTSREPGLVLLPPVEQPEPTTWTGPEQVPVDTFSWDLPIKVLPTSPTLASYAAPGPSTSTITI

SEQ ID NO: 61624 - protein, 431 aa, Homo sapiens
MTRALSGLACRALPAGRDSAEGLGVPIPSVDYARSDSGAAMIEVVAELSRGPVFLAGEALECVVTVTNPLPPTATSASSEALAWASAQIHCQFHASESRVALPPPDSSQPDVQPDSQTVFLPHRGERGQCILSTPPKILFCDLRLDPGESKSYSYSEVLPIEGPPSFRGQSVKYVYKLTIGCQRVNSPITLLRVPLRVLVLTGLQDVRFPQDEAVAPSSPFLEEDEGGKKDSWLAELAGERLMAATSCRSLHLYNISDGRGKVGTFGIFKSVYRLGEDVVGTLNLGEGTVACLQFSVSLQTEERVQPEYQRRRGAGGVPSVSHVTHARHQESCLHTTRTSFSLPIPLSSTPGFCTAIVSLKWRLHFEFVTSREPGLVLLPPVEQPEPTTWTGPEQVPVDTFSWDLPIKVLPTSPTLASYAAPGPSTSTITI

SEQ ID NO: 61625 - protein, 372 aa, Homo sapiens
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMTYVHSAVLAGGVAVGTSCHLIPSPWLAMVLGLVAGLISIGGAKCLPVCCNRVLGIHHISVMHSIFSLLGLLGEITYIVLLVLHTVWNGNGMFAPKSQNMESTSCG

SEQ ID NO: 61626 - protein, 417 aa, Homo sapiens
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMTYVHSAVLAGGVAVGTSCHLIPSPWLAMVLGLVAGLISIGGAKCLPVCCNRVLGIHHISVMHSIFSLLGLLGEITYIVLLVLHTVWNGNGMIGFQVLLSIGELSLAIVIALTSGLLTGLLLNLKIWKAPHVAKYFDDQVFWKFPHLAVGF

SEQ ID NO: 61627 - protein, 267 aa, Homo sapiens
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTYVHSAVLAGGVAVGTSCHLIPSPWLAMVLGLVAGLISIGGAKCLPVCCNRVLGIHHISVMHSIFSLLGLLGEITYIVLLVLHTVWNGNGMFAPKSQNMESTSCG

SEQ ID NO: 61628 - protein, 266 aa, Homo sapiens
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNVCCNRVLGIHHISVMHSIFSLLGLLGEITYIVLLVLHTVWNGNGMIGFQVLLSIGELSLAIVIALTSGLLTGLLLNLKIWKAPHVAKYFDDQVFWKFPHLAVGF

SEQ ID NO: 61629 - protein, 401 aa, Homo sapiens
MYFINQRLFLRLWRVPVMRASHCYQSQGWRPVAVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMTYVHSAVLAGGVAVGTSCHLIPSPWLAMVLGLVAGLISIGGAKCLPVCCNRVLGIHHISVMHSIFSLLGLLGEITYIVLLVLHTVWNGNGMIGFQVLLSIGELSLAIVIALTSGLLTGLLLNLKIWKAPHVAKYFDDQVFWKFPHLAVGF

SEQ ID NO: 61630 - protein, 354 aa, Homo sapiens
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMTYVHSAVLAGGVAVGTSCHLIPSPWLAMVLGLVAGLISIGGAKCLPDWLPGPPQHWGTQLGHRDSSHVWSPDRFAPKSQNMESTSCG

SEQ ID NO: 61631 - protein, 401 aa, Homo sapiens; identical to SEQ ID NO: 61629

SEQ ID NO: 61632 - protein, 396 aa, Homo sapiens
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMTYVHSAVLAGGVAVGTSCHLIPSPWLAMVLGLVAGLISIGGAKCLPVCCNRVLGIHHISVMHSIFSLLGLLGEITYIVLLVLHTVWNGNGIFLIWLLDFKQKHPRKTRPVQKQDNFLSLLPAFVREKRS

SEQ ID NO: 61633 - protein, 308 aa, Homo sapiens
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMDWLPGPPQHWGTQLGHRDSSHVWSPDRFAPKSQNMESTSCG

SEQ ID NO: 61634 - protein, 398 aa, Homo sapiens
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMTYVHSAVLAGGVAVGTSCHLIPSPWLAMVLGLVAGLISIGGAKCLPVCCNRVLGIPHLRHALHLQLAGSAWRDHLHCAAGASYCLERQWHDWLPGPPQHWGTQLGHRDSSHVWSPDRFAPKSQNMESTSCG

SEQ ID NO: 61635 - protein, 312 aa, Homo sapiens
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTYVHSAVLAGGVAVGTSCHLIPSPWLAMVLGLVAGLISIGGAKCLPVCCNRVLGIHHISVMHSIFSLLGLLGEITYIVLLVLHTVWNGNGMIGFQVLLSIGELSLAIVIALTSGLLTGLLLNLKIWKAPHVAKYFDDQVFWKFPHLAVGF

SEQ ID NO: 61636 - protein, 346 aa, Homo sapiens
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNPSVNSALLRSPIQRKNAMFNTYYALAVSVVTAISGSSLAHPQRKISMTYVHSAVLAGGVAVGTSCHLIPSPWLAMVLGLVVCCNRVLGIHHISVMHSIFSLLGLLGEITYIVLLVLHTVWNGNGMIGFQVLLSIGELSLAIVIALTSGLLTGLLLNLKIWKAPHVAKYFDDQVFWKFPHLAVGF

SEQ ID NO: 61637 - protein, 417 aa, Homo sapiens
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPGCCNRVLGIPHSSIMGYNFSLLGLLGEIIYIVLLVLDTVGAGNGMIGFQVLLSIGELSLAIVIALMSGLLTGLLLNLKIWKAPHEAKYFDDQVFWKFPHLAVGF

SEQ ID NO: 61638 - protein, 493 aa, Homo sapiens
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPGCCNRVLGIPHSSIMGYNFSLLGLLGEIIYIVLLVLDTVGAGNGMSLGWNLAVKMAEAGDEELMRLDVSQRNHGGAAVPTGSWMPSTETTIAPNYRDHISVVSSFGCWILSKSIQEKQGLFKNKTTSSHCCLHLYVRNAHDSKVSNVRAGTGVRENGVESFLCHSLRRISPFIMHCRIQQ

SEQ ID NO: 61639 - protein, 396 aa, Homo sapiens
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPGCCNRVLGIPHSSIMGYNFSLLGLLGEIIYIVLLVLDTVGAGNGIFLIWLLDFKQKHPRKTRPVQKQDNFLSLLPAFVREKRS

SEQ ID NO: 61640 - protein, 378 aa, Homo sapiens
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPDWLPGPPQHWGTQLGHRDSSHVWSPDSFLIWLLDFKQKHPRKTRPVQKQDNFLSLLPAFVREKRS

SEQ ID NO: 61641 - protein, 487 aa, Homo sapiens
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPGCCNRVLGIPHSSIMGYNFSLLGLLGEIIYIVLLVLDTVGAGNGMIGFQVLLSIGELSLAIVIALMSGLLTGLLLNLKIWKAPHEAKYFDDQVFWKFPHLAVGFSKSIQEKQGLFKNKTTSSHCCLHLYVRNAHDSKVSNVRAGTGVRENGVESFLCHSLRRISPFIMHCRIQQ

SEQ ID NO: 61642 - protein, 431 aa, Homo sapiens
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPGCCNRVLGIPHSSIMGYNFSLLGLLGEIIYIVLLVLDTVGAGNGMSLGWNLAVKMAEAGDEELMRLDVSQRNHGGAAVPTGSWMPSTETTIAPNYRDHISVGLASRSSSALGNSAWPS

SEQ ID NO: 61643 - protein, 321 aa, Homo sapiens
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPFPHLAVGF

SEQ ID NO: 61644 - protein, 97 aa, Homo sapiens
MAGSPSRAAGRRLQLPLLCLFLQGATAVLFAVFVRYNHKTDAALWHRSNHSNADNEFYFRYPNGVSLLLPRLECNGTISAHHNLCLPGSSDSPASVS

SEQ ID NO: 61645 - protein, 153 aa, Homo sapiens
MAGSPSRAAGRRLQLPLLCLFLQGATAVLFAVFVRYNHKTDAALWHRSNHSNADNEFYFRYPKESHSVAQAGVQRRNLGSLQPSPPRLPGRACHGLRGLWLPHGLPAALRLQQRGLHLPPGRLCPAVVHTGPGLSPLLPRWPHPCWRGEHDQC

SEQ ID NO: 61646 - protein, 372 aa, Homo sapiens
MVFVGFGFLMVFLQRYGFSSVGFTFLLAAFALQWSTLVQGFLHSFHGGHIHVGVESMINADFCAGAVLISFGAVLGKTGPTQLLLMALLEVVLFGINEFVLLHLLGVRDAGGSMTIHTFGAYFGLVLSRVLYRPQLEKSKHRQGSVYHSDLFAMIGTIFLWIFWPSFNAALTALGAGQHRTALNTYYSLAASTLGTFALSALVGEDGRLDMVHIQNAALAGGVVVGTSSEMMLTPFGALAAGFLAGTVSTLGYKFFTPILESKFKVQDTCGVHNLHGMPGVLGALLGVLVAGLATHEAYGDGLESVFPLIAEGQRSATSQAMHQLFGLFVTLMFASVGGGLGGLLLKLPFLDSPPRLPALRGPSSLAGAWRA

SEQ ID NO: 61647 - protein, 457 aa, Homo sapiens
MAGSPSRAAGRRLQLPLLCLFLQGATAVLFAVFVRYNHKTDAALWHRSNHSNADNEFYFRYPSFQDVHAMVFVGFGFLMVFLQRYGFSSVGFTFLLAAFALQWSTLVQGFLHSFHGGHIHVGVESMINADFCAGAVLISFGAVLGKTGPTQLLLMALLEVVLFGINEFVLLHLLGVRDAGGSMTIHTFGAYFGLVLSRVLYRPQLEKSKHRQGSVYHSDLFAMIGTIFLWIFWPSFNAALTALGAGQHRTALNTYYSLAASTLGTFALSALVGEDGRLDMVHIQNAALAGGVVVGTSSEMMLTPFGALAAGFLAGTVSTLGYKFFTPILESKFKVQDTCGVHNLHGMPGVLGALLGVLVAGLATHEAYGDGLESVFPLIAEGQRSATSQAMHQLFGLFVTLMFASVGGGLGGLLLKLPFLDPPDSQHYEDQVHWQVPGEHEDKAQRPLRVEEADTQA

SEQ ID NO: 61648 - protein, 441 aa, Homo sapiens
MAGSPSRAAGRRLQLPLLCLFLQGATAVLFAVFVRYNHKTDAALWHRSNHSNADNEFYFRYPSFQDVHAMVFVGFGFLMVFLQRYGFSSVGFTFLLAAFALQWSTLVQGFLHSFHGGHIHVGVESMINADFCAGAVLISFGAVLGKTGPTQLLLMALLEVVLFGINEFVLLHLLGVRDAGGSMTIHTFGAYFGLVLSRVLYRPQLEKSKHRQGSVYHSDLFAMIGTIFLWIFWPSFNAALTALGAGQHRTALNTYYSLAASTLGTFALSALVGEDGRLDMVHIQNAALAGGVVVGTSSEMMLTPFGALAAGFLAGTVSTLGYKFFTPILESKFKVQDTCGVHNLHGMPGVLGALLGVLVAGLATHEAYGDGLESVFPLIAEGQRSATSQAMHQLFGLFVTLMFASVGGGLGGLLLKLPFLDSPPRLPALRGPSSLAGAWRA

SEQ ID NO: 61649 - protein, 409 aa, Homo sapiens
MVFVGFGFLMVFLQRYGFSSVGFTFLLAAFALQWSTLVQGFLHSFHGGHIHVGVESMINADFCAGAVLISFGAVLGKTGPTQLLLMALLEVVLFGINEFVLLHLLGVRVWGGMESGVGGGQGQPLSQERGGGGGVLPLTPPPQVRDAGGSMTIHTFGAYFGLVLSRVLYRPQLEKSKHRQGSVYHSDLFAMIGTIFLWIFWPSFNAALTALGAGQHRTALNTYYSLAASTLGTFALSALVGEDGRLDMVHIQNAALAGGVVVGTSSEMMLTPFGALAAGFLAGTVSTLGYKFFTPILESKFKVQDTCGVHNLHGMPGVLGALLGVLVAGLATHEAYGDGLESVFPLIAEGQRSATSQAMHQLFGLFVTLMFASVGGGLGGLLLKLPFLDSPPRLPALRGPSSLAGAWRA

SEQ ID NO: 61650 - protein, 374 aa, Homo sapiens
MVFVGFGFLMVFLQRYGFSSVGFTFLLAAFALQWSTLVQGFLHSFHGGHIHVGVESMINADFCAGAVLISFGAVLGKTGPTQLLLMALLEVVLFGINEFVLLHLLGVRVWGGMESGVGGGQGQPLSQERGGGGGVLPLTPPPQVRDAGGSMTIHTFGAYFGLVLSRVLYRPQLEKSKHRQGSVYHSDLFAMIGTIFLWIFWPSFNAALTALGAGQHRTALNTYYSLAASTLGTFALSALVGEDGRLDMPILESKFKVQDTCGVHNLHGMPGVLGALLGVLVAGLATHEAYGDGLESVFPLIAEGQRSATSQAMHQLFGLFVTLMFASVGGGLGGIILVLCLLDPCALWHWVAPSSMVGGREASQILPYHHQGSC

SEQ ID NO: 61651 - protein, 228 aa, Homo sapiens
MAGSPSRAAGRRLQLPLLCLFLQGATAVLFAVFVRYNHKTDAALWHRSNHSNADNEFYFRYPRTIFLWIFWPSFNAALTALGAGQHRTALNTYYSLAASTLGTFALSALVGEDGRLDMVHIQNAALAGGVVVGTSSEMMLTPFGALAAGFLAGTVSTLGPSLNQNSKSKTHVESTTSMGCRGSWGPSWGSLWLDLPPMKLTEMGEFPPNPYCSRHPSGMTSVILFHCV

SEQ ID NO: 61652 - protein, 479 aa, Homo sapiens
MAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENLINADFCVASVCVAFGAVLGKVSPIQLLIMTFFQVTLFAVNEFILLNLLKVKDAGGSMTIHTFGAYFGLTVTRILYRRNLEQSKERQNSVYQSDLFAMIGTLFLWMYWPSFNSAISYHGDSQHRAAINTYCSLAACVLTSVAISSALHKKGKLDMVHIQNATLAGGVAVGTAAEMMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 61653 - protein, 470 aa, Homo sapiens
MAWNTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENLINADFCVASVCVAFGAVLGKVSPIQLLIMTFFQVTLFAVNEFILLNLLKVKDAGGSMTIHTFGAYFGLTVTRILYRRNLEQSKERQNSVYQSDLFAMIGTLFLWMYWPSFNSAISYHGDSQHRAAINTYCSLAACVLTSVAISSALHKKGKLDMVHIQNATLAGGVAVGTAAEMMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 61654 - protein, 445 aa, Homo sapiens
MAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENLINADFCVASVCVAFGAVLGKVSPIQLLIMTFFQVTLFAVNEFILLNLLKVKDAGGSMTIHTFGAYFGLTVTRILYRRNLEQSKERQNSVYQSDLFAMIGTLFLWMYWPSFNSAISYHGDSQHRAAINTYCSLAACVLTSVAISSALHKKGKLDMVHIQNATLAGGVAVGTAAEMMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEDLELAPNQ

SEQ ID NO: 61655 - protein, 237 aa, Homo sapiens
  MOD_RES (1)..(1): Any amino acid
XDSQHRAAINTYCSLAACVLTSVAISSALHKKGKLDMVHIQNATLAGGVAVGTAAEMMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 61656 - protein, 348 aa, Homo sapiens
MAHSQNSLELPININATQITTAYGHRALPKLKEELQSEDLQTRQKALMALCDLMHDPECIYKAMNIGCMENLKALLKDSNSMVRIKTTEVLHITASHSVGRYAFLEHDIVLALSFLLNDPSPVCRGNLYKAYMQLVQVPRGAQEIISKGLISSLVWKLQVEVEEEEFQEFILDTLVLCLQEDATEALGSNVVLVLKQKLLSANQNIRSKAARALLNVSISREGKKQVCHFDVIPILVHLLKDPVEHVKSNAAGALMFATVITEGKYAALEAQAIGLLLELLHSPMTIARLNATKALTMLAEAPEGRKALQTHVPTFRAMEVETYEKPQVAEALQRAARIAISVIEFKP

SEQ ID NO: 61657 - protein, 351 aa, Homo sapiens
MRFTFPLMAIVLEIAMIVLFGLFVEYETDQTVLEQLNITKPTDMGIFFELYPLFQDVHVMIFVGFGFLMTFLKKYGFSSVGINLLVAALGLQWGTIVQGILQSQGQKFNIGIKNMINADFSAATVLISFGAVLGKTSPTQMLIMTILEIVFFAHNEYLVSEIFKASDIGASMTIHAFGAYFGLAVAGILYRSGLRKGHENEESAYYSDLFAMIGTLFLWMFWPSFNSAIAEPGDKQCRAIVNTYFSLAACVLTAFAFSSLVEHRGKLNMVHIQNATLAGGVAVGTCADMAIHPFGSMIIGSIAGMVSVLGYKFLTVYGHAGSCTGFLYRNSSCWRSDDRFNSKVASLGTAI

SEQ ID NO: 61658 - protein, 409 aa, Homo sapiens
MRFTFPLMAIVLEIAMIVLFGLFVEYETDQTVLEQLNITKPTDMGIFFELYPLFQDVHVMIFVGFGFLMTFLKKYGFSSVGINLLVAALGLQWGTIVQGILQSQGQKFNIGIKNMINADFSAATVLISFGAVLGKTSPTQMLIMTILEIVFFAHNEYLVSEIFKASDIGASMTIHAFGAYFGLAVAGILYRSGLRKGHENEESAYYSDLFAMIGTLFLWMFWPSFNSAIAEPGDKQCRAIVNTYFSLAACVLTAFAFSSLVEHRGKLNMVHIQNATLAGGVAVGTCADMAIHPFGSMIIGSIAGMVSVLGYKFLTPLFTTKLRIHDTCGVHNLHGLPGVVGGLAGIVAVAMGASNTSMAMQAAALGSSIGTAVVGGLMTGLILKLPLWGQPSDQNCYDDSVYWKVPKTR

SEQ ID NO: 61659 - protein, 410 aa, Homo sapiens [sequence omitted]

SEQ ID NO: 61660 - protein, 381 aa, Homo sapiens [sequence omitted]

SEQ ID NO: 61661 - protein, 201 aa, Homo sapiens
MTEKAPEPHVEEDDDDELDSKLNYKPPPQKSLKELQEMDKDDESLIKYKKTLLGDGPVVTDPKAPNVVVTRLTLVCESAPGPITMDLTGDLEALKKETIVLKEGSEYRVKIHFKVNRDIVSGLKYVQHTYRTGVKVDKATFMVGSYGPRPEEYEFLTPVEEAPKGMLARGTYHNKSFFTDDDKQDHLSWEWNLSIKKEWTE

SEQ ID NO: 61662 - protein, 112 aa, Homo sapiens
MTEKAPEPHVEEDDDDELDSKLNYKPPPQKSLKELQEMDKDDESLIKYKKTLLGDGPVVTDPKAPNVVVTRLTLVCESAPGPITMDLTGDLEALKKETIVLKEGSEYRVKIH

SEQ ID NO: 61663 - protein, 201 aa, Homo sapiens; identical to SEQ ID NO: 61661

SEQ ID NO: 61664 - protein, 201 aa, Homo sapiens; identical to SEQ ID NO: 61661

SEQ ID NO: 61665 - protein, 88 aa, Homo sapiens
MTEKAPEPHVEEDDDDELDSKLNYKPPPQKSLKELQEMDKDDESLIKYKKTLLGDGPVVTDPKAPNVVVTRLTLVCESAPGPITMDLT

SEQ ID NO: 61666 - protein, 159 aa, Homo sapiens
MTEKAPEPHVEEDDDDELDSKLNYKPPPQKSLKELQEMDKDDESLIKYKKTLLGDGPVVTDPKAPNVVVTRLTLVCESAPGPITMDLTGDLEALKKETIVLKEGSEYRVKIHFKVNRDIVSGLKYVQHTYRTGVKVDKATFMVGSYGPRPEEYEFLTPV

SEQ ID NO: 61667 - protein, 439 aa, Homo sapiens
MDPLSELQDDLTLDDTSEALNQLKLASIDEKNWPSDEMPDFPKSDDSKSSSPELVTHLKWDDPYYDIARHQIVEVAGDDKYGRKIIVFSACRMPPSHQLDHSKLLGYLKHTLDQYVESDYTLLYLHHGLTSDNKPSLSWLRDAYREFDRKYKKNIKALYIVHPTMFIKTLLILFKPLISFKFGQKIFYVNYLSELSEHVKLEQLGIPRQVLKYDDFLKSTQKSPATAPKPMPPRPPLPNQQFGVSLQHLQEKNPEQEPIPIVLRETVAYLQAHALTTEGIFRRSANTQVVREVQQKYNMGLPVDFDQYNELHLPAVILKTFLRELPEPLLTFDLYPHVVGFLNIDESQRVPATLQVLQTLPEENYQVLRFLTAFLVQISAHSDQNKMTNTNLAVVFGPNLLWAKDAAITLKAINPINTFTKFLLDHQGELFPSPDPSGL

SEQ ID NO: 61668 - protein, 458 aa, Homo sapiens
MDPLSELQDDLTLDDTSEALNQLKLASIDEKNWPSDEMPDFPKSDDSKSSSPELVTHLKWDDPYYDIARHQIVEVAGDDKYGRKIIVFSACRMPPSHQLDHSKLLGYLKHTLDQYVESDYTLLYLHHGLTSDNKPSLSWLRDAYREFDRKYKKNIKALYIVHPTMFIKTLLILFKPLISFKFGQKIFYVNYLSELSEHVKLEQLGIPRQVLKYDDFLKSTQKSPATAPKPMPPRPPLPNQQFGVSLQHLQEKNPEQEPIPIVLRETVAYLQAHALTTEGIFRRSANTQVVREVQQKYNMGLPVDFDQYNELHLPAVILKTFLRELPEPLLTFDLYPHVVGFLNIDESQRVPATLQVLQTLPEENYQVLRFLTAFLVQISAHSDQNKMTNTNLAVVFGPNLLWAKDAAITLKAINPMATFFFFFLRWSLALSPGWSAVARSRHTSAFWVQAILLPQPPE

SEQ ID NO: 61669 - protein, 192 aa, Homo sapiens
MDPLSELQDDLTLDDTSEALNQLKLASIDEKNWPSDEMPDFPKSDDSKSSSPELVTHLKWDDPYYDIARHQIVEVAGDDKYGRKIIVFSACRMPPSHQLDHSKLLGYLKHTLDQYVESDYTLLYLHHGLTSDNKPSLSWLRDAYREFDRKYKKNIKALYIVHPTMFIKTLLILFKPLISFKFGQKIFYVNYL

SEQ ID NO: 61670 - protein, 786 aa, Homo sapiens
MGLQPLEFSDCYLDSPWFRERIRAHEAELERTNKFIKELIKDGKNLIAATKSLSVAQRKFAHSLRDFKFEFIGDAVTDDERCIDASLREFSNFLKNLEEQREIMALSVTETLIKPLEKFRKEQLGAVKEEKKKFDKETEKNYSLIDKHLNLSAKKKDSHLQEADIQVEQNRQHFYELSLEYVCKLQEIQERKKFEFVEPMLSFFQGMFTFYHQGHELAKDFNHYKMELQINIQNTRNRFEGTRSEVEELMNKIRQNPKDHKRASQFTAEGYLYVQEKRPAPFGSSWVKHYCMYRKAAKKFNMIPFEHRSGGKLGDGEVFFLKECTKRHTDSIDRRFCFDIEAADRPGVSLTMQAFSEEERKQWLEALGGKEALSHSFNTAIIPRPEGNAQLDKMGFTIIRKCISAVETRGINDQGLYRVVGVSSKVQRLLSMLMDVKTCNEVDLENSADWEVKTITSALKQYLRSLPEPLMTYELHGDFIVPAKSGSPESRVNAIHFLVHKLPEKNKEMLDILVKHLTNVSNHSKQNLMTVANLGVVFGPTLMRPQEETVAALMDLKFQNIVVEILIENHEKIFRTPPDTTFPEPTCLSASPPNAPPRQSKRQGQRTKRPVAVYNLCLELEDGDNPYPSKEDTPTSSLDSLSSPSPVTTAVPGPPGPDKNHLLADGGSFGDWASTIPGQTRSSMVQWLNPQSPTTTSSNSAVTPLSPGSSPFPFSPPATVADKPPESIRSRKARAVYPCEAEHSSELSFEIGAIFEDVQTSREPGWLEGTLNGKRGLIPQNYVKLL

SEQ ID NO: 61671 - protein, 384 aa, Homo sapiens
MQAFSEEERKQWLEALGGKEALSHSFNTAIIPRPEGNAQLDKMGFTIIRKCISAVETRGINDQGLYRVVGVSSKVQRLLSMLMDVKTCNEVDLENSADWEVKTITSALKQYLRSLPEPLMTYELHGDFIVPAKSGSPESRVNAIHFLVHKLPEKNKEMLDILVKHLTNVSNHSKQNLMTVANLGVVFGPTLMRPQEETVAALMDLKFQNIVVEILIENHEKIFRTPPDTTFPEPTCLSASPPNAPPRQSKRQGQRTKRPVAVYNLCLELEDGDNPYPSKEDTPTSSLDSLSSPSPVTTAVPGPPGPDKNHLLADGGSFGDWASTIIRSRKARAVYPCEAEHSSELSFEIGAIFEDVQTSREPGWLEGTLNGKRGLIPQNYVKLL

SEQ ID NO: 61672 - protein, 1023 aa, Homo sapiens
MWDQRLVRLALLQHLRAFYGIKVKGVRGQCDRRRHETAATEIGGKIFGVPFNALPHSAVPEYGHIPSFLVDACTSLEDHIHTEGLFRKSGSVIRLKALKNKVDHGEGCLSSAPPCDIAGLLKQFFRELPEPILPADLHEALLKAQQLGTEEKNKATLLLSCLLADHTVHVLRYFFNFLRNVSLRSSENKMDSSNLAVIFAPNLLQTSEGHEKMSSNTEKKLRLQAAVVQTLIDYASDIGRVPDFILEKIPAMLGIDGLCATPSLEGFEEGEYETPGEYKRKRRQSVGDFVSGALNKFKPNRTPSITPQEERIAQLSESPVILTPNAKRTLPVDSSHGFSSKKRKSIKHNFNFELLPSNLFNSSSTPVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGSEKISKSEETLLTPERLVGTNYRMSWTGPNNSSFQEVDANEASSMVENLEVENSLEPDIMVEKSPATSCELTPSNLNNKHNSNITSSPLSGDENNMTKETLVKVQKAFSESGSNLHALMNQRQSSVTNVGKVKLTEPSYLEDSPEENLFETNDLTIVESKEKYEHHTGKGEKCFSERDFSPLQTQTFNRETTIKCYSTQMKMEHEKDIHSNMPKDYLSKQEFSSDEEIKKQQSPKDKLNNKLKENENMMEGNLPKCAAHSKDEARSSFSQQSTCVVTNLSKPRPMRIAKQQSLETCEKTVSESSQMTEHRKVSDHIQWFNKLSLNEPNRIKVKSPLKFQRTPVRQSVRRINSLLEYSRQPTGHKLASLGDTASPLVKSVSCDGALSSCIESASKDSSVSCIKSGPKEQKSMSCEESNIGAISKSSMELPSKSFLKMRKHPDSVNASLRSTTVYKQKILSDGQVKVPLDDLTNHDIVKPVVNNNMGISSGINNRVLRRPSERGRAWYKGSPKHPIGKTQLLPTSKPVDL

SEQ ID NO: 61673 - protein, 834 aa, Homo sapiens
MDSSNLAVIFAPNLLQTSEGHEKMSSNTEKKLRLQAAVVQTLIDYASDIGRVPDFILEKIPAMLGIDGLCATPSLEGFEEGEYETPGEYKRKRRQSVGDFVSGALNKFKPNRTPSITPQEERIAQLSESPVILTPNAKRTLPVDSSHGFSSKKRKSIKHNFNFELLPSNLFNSSSTPVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGSEKISKSEETLLTPERLVGTNYRMSWTGPNNSSFQEVDANEASSMVENLEVENSLEPDIMVEKSPATSCELTPSNLNNKHNSNITSSPLSGDENNMTKETLVKVQKAFSESGSNLHALMNQRQSSVTNVGKVKLTEPSYLEDSPEENLFETNDLTIVESKEKYEHHTGKGEKCFSERDFSPLQTQTFNRETTIKCYSTQMKMEHEKDIHSNMPKDYLSKQEFSSDEEIKKQQSPKDKLNNKLKENENMMEGNLPKCAAHSKDEARSSFSQQSTCVVTNLSKPRPMRIAKQQSLETCEKTVSESSQMTEHRKVSDHIQWFNKLSLNEPNRIKVKSPLKFQRTPVRQSVRRINSLLEYSRQPTGHKLASLGDTASPLVKSVSCDGALSSCIESASKDSSVSCIKSGPKEQKSMSCEESNIGAISKSSMELPSKSFLKMRKHPDSVNASLRSTTVYKQKILSDGQVKVPLDDLTNHDIVKPVVNNNMGISSGINNRVLRRPSERGRAWYKGSPKHPIGKTQLLPTSKPVDL

SEQ ID NO: 61674 - protein, 501 aa, Homo sapiens
MWDQRLVRLALLQHLRAFYGIKVKGVRGQCDRRRHETAATEIGGKIFGVPFNALPHSAVPEYGHIPSFLVDACTSLEDHIHTEGLFRKSGSVIRLKALKNKVDHGEGCLSSAPPCDIAGLLKQFFRELPEPILPADLHEALLKAQQLGTEEKNKATLLLSCLLADHTVHVLRYFFNFLRNVSLRSSENKMDSSNLAVIFAPNLLQTSEGHEKMSSNTEKKLRLQAAVVQTLIDYASDIGRVPDFILEKIPAMLGIDGLCATPSLEGFEEGEYETPGEYKRKRRQSVGDFVSGALNKFKPNRTPSITPQEERIAQLSESPVILTPNAKRTLPVDSSHGFSSKKRKSIKHNFNFELLPSNLFNSSSTPVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGTFTYYC

SEQ ID NO: 61675 - protein, 794 aa, Homo sapiens
MKMADRSGKIIPGQVYIEVEYDYEYEAKDRKIVIKQGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQEWLKHVDDQGRQYYYSADGSRSEWELPKYNASSQQQREIIKSRSLDRRLQEPIVLTKWRHSTIVLDTNDKESPTASKPCFPENESSPSSPKHQDTDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 61676 - protein, 846 aa, Homo sapiens
MKMADRSGKIIPGQVYIEVEYDYEYEAKDRKIVIKQGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQELLSSEENYYSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKESPTASKPCFPENESSPSSPKHQDTASSPKDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 61677 - protein, 794 aa, Homo sapiens; identical to SEQ ID NO: 61675

SEQ ID NO: 61678 - protein, 816 aa, Homo sapiens
MKMADRSGKIIPGQVYIEVEYDYEYEAKDRKIVIKQGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQELLSSEENYYSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 61679 - protein, 841 aa, Homo sapiens
MKMADRSGKIIPGQVYIEVEYDYEYEAKDRKIVIKQGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQELLSSEENYYSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKESPTASKPCFPENESSPSSPKHQDTDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 61680 - protein, 196 aa, Homo sapiens
  MOD_RES (1)..(1): Any amino acid
XSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKESPTASKPCFPENESSPSSPKHQDTDQEKYGLLNVTKIAENGKKVRKNWLSSWAVLQGSSLLFTKTQGSSTSWFGSNQSKPEFTVDLK

SEQ ID NO: 61681 - protein, 881 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESFGVKLMDFQAHRRGGTLNRKHISPAFQPPLPPTDGSTVVPAGPEPPPQSSRAESSSGGGTVPSSAGILEQGPSPGDGSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 61682 - protein, 803 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 61683 - protein, 226 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTISGRKNQPLGLP

SEQ ID NO: 61684 - protein, 840 aa, Homo sapiens
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESFGVKLMDFQAHRRGGTLNRKHISPAFQPPLPPTDGSTVVPAGPEPPPQSSRAESSSGGGTVPSSAGILEQGPSPGDGSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTGV

SEQ ID NO: 61685 - protein, 663 aa, Homo sapiens
MSWLSSSQGVVLTAYHPSGKDQTVGNSHAKAGEEATSSRRYGQYTMNQESTTIKVMEKPPFDRSISQDSLDELSMEDYWIELENIKKSSENSQEDQEVVVVKEPDEGELEEEWLKEAGLSNLFGESAGDPQESIVFLSTLTRTQAAAVQKRVETVSQTLRKKNKQYQIPDVRDIFAQQRESKETAPGGTESQSLRTNENKYQGRDDEASNLVGEEKLIPPEETPAPETDINLEVSFAEQALNQKESSKEKIQKSKGDDATLPSFRLPKDKTGTTRIGDLAPQDMKKVCHLALIELTALYDVLGIELKQQKAVKIKTKDSGLFCVPLTALLEQDQRKVPGMRIPLIFQKLISRIEERGLETEGLLRIPGAAIRIKNLCQELEAKFYEGTFNWESVKQHDAASLLKLFIRELPQPLLSVEYLKAFQAVQNLPTKKQQLQALNLLVILLPDANRDTLKALLEFLQRVIDNKEKNKMTVMNVAMVMAPNLFMCHALGLKSSEQREFVMAAGTANTMHLLIKYQKLLWTIPKFIVNQVRKQNTENHKKDKRAMKKLLKKMAYDREKYEKQDKSTNDADVPQGVIRVQAPHLSKVSMAIQLTEELKASDVLARFLSQESGVAQTLKKGEVFLYEIGGNIGERCLDDDTYMKDLYQLNPNAEWVIKSKPL

SEQ ID NO: 61686 - protein, 618 aa, Homo sapiens
MNQESTTIKVMEKPPFDRSISQDSLDELSMEDYWIELENIKKSSENSQEDQEVVVVKEPDEGELEEEWLKEAGLSNLFGESAGDPQESIVFLSTLTRTQAAAVQKRVETVSQTLRKKNKQYQIPDVRDIFAQQRESKETAPGGTESQSLRTNENKYQGRDDEASNLVGEEKLIPPEETPAPETDINLEVSFAEQALNQKESSKEKIQKSKGDDATLPSFRLPKDKTGTTRIGDLAPQDMKKVCHLALIELTALYDVLGIELKQQKAVKIKTKDSGLFCVPLTALLEQDQRKVPGMRIPLIFQKLISRIEERGLETEGLLRIPGAAIRIKNLCQELEAKFYEGTFNWESVKQHDAASLLKLFIRELPQPLLSVEYLKAFQAVQNLPTKKQQLQALNLLVILLPDANRDTLKALLEFLQRVIDNKEKNKMTVMNVAMVMAPNLFMCHALGLKSSEQREFVMAAGTANTMHLLIKYQKLLWTIPKFIVNQVRKQNTENHKKDKRAMKKLLKKMAYDREKYEKQDKSTNDADVPQGVIRVQAPHLSKVSMAIQLTEELKASDVLARFLSQESGVAQTLKKGEVFLYEIGGNIGERCLDDDTYMKDLYQLNPNAEWVIKSKPL

SEQ ID NO: 61687 - protein, 494 aa, Homo sapiens
MATEAQSEGEVPARESGRSDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKVFL

SEQ ID NO: 61688 - protein, 485 aa, Homo sapiens
MPHQKLSALIDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKVFL

SEQ ID NO: 61689 - protein, 465 aa, Homo sapiens
MATEAQSEGEVPARESGRSDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKAFV

SEQ ID NO: 61690 - protein, 494 aa, Homo sapiens
MATEAQSEGEVPARESGRSDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKGFL

SEQ ID NO: 61691 - protein, 485 aa, Homo sapiens
MPHQKLSALIDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKGFL

SEQ ID NO: 61692 - protein, 313 aa, Homo sapiens
MFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKGFL

SEQ ID NO: 61693 - protein, 517 aa, Homo sapiens
MATEAQSEGEVPARESGRSDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKGNSMATTSLGSIRMTLRGSSSCGCCS

SEQ ID NO: 61694 - protein, 1217 aa, Homo sapiens
MAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSQFKKIPPDLKTLQSNRNFQTTCGMSLPRGISQDRSPLVKVRSNSLKAPSTHVTKPSFSQKSFVSIKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIMRKTFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSGEVGGVYHTVMSLVDSVMSLMDSWNCRKKEDCCPHCSCLVCRNPRFL

SEQ ID NO: 61695 - protein, 1165 aa, Homo sapiens
MMATRRTGLSEGDGDKLKACEVSKNKDGKEQSETVSLSEDETFSWPGPKTVTLKRTSQGFGFTLRHFIVYPPESAIQFSYKDEENGNRGGKQRNRLEPMDTIFVKQVKEGGPAFEAGLCTGDRIIKVNGESVIGKTYSQVIALIQNSDTTLELSVMPKDEDILQVAYSQDAYLKGNEAYSGNARNIPEPPPICYPWLPSAPSAMAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSQFKKIPPDLKTLQSNRNFQTTCGMSLPRGISQDRSPLVKVRSNSLKAPSTHVTKPSFSQKSFVSIKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIMRKTFEKKPTATGTFGVRLDDCPPAHTNRVGDTSPPDFLKSLIQF

SEQ ID NO: 61696 - protein, 1958 aa, Homo sapiens
MMATRRTGLSEGDGDKLKACEVSKNKDGKEQSETVSLSEDETFSWPGPKTVTLKRTSQGFGFTLRHFIVYPPESAIQFSYKDEENGNRGGKQRNRLEPMDTIFVKQVKEGGPAFEAGLCTGDRIIKVNGESVIGKTYSQVIALIQNSDTTLELSVMPKDEDILQVLQFTKDVTALAYSQDAYLKGNEAYSGNARNIPEPPPICYPWLPSAPSAMAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSQFKKIPPDLKTLQSNRNFQTTCGMSLPRGISQDRSPLVKVRSNSLKAPSTHVTKPSFSQKSFVSIKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIMRKTFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGSKAEFHPCL

SEQ ID NO: 61697 - protein, 197 aa, Homo sapiens
  MOD_RES (1)..(1): Any amino acid
XNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLIQLLVTQQNLRVLGDLERISIAGNCLCPPSLQLLV

SEQ ID NO: 61698 - protein, 113 aa, Homo sapiens
YIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLFLSAHLKTVA

SEQ ID NO: 61699 - protein, 907 aa, Homo sapiens
MPKDEDILQVAYSQDAYLKGNEAYSGNARNIPEPPPICYPWLPSAPSAMAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSQFKKIPPDLKTLQSNRNFQTTCGMSLPRGISQDRSPLVKVRSNSLKAPSTHVTKPSFSQKSFVSIKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLP

SEQ ID NO: 61700 - protein, 1131 aa, Homo sapiens
MMATRRTGLSEGDGDKLKACEVSKNKDGKEQSETVSLSEDETFSWPGPKTVTLKRTSQGFGFTLRHFIVYPPESAIQFSYKDEENGNRGGKQRNRLEPMDTIFVKQVKEGGPAFEAGLCTGDRIIKVNGESVIGKTYSQVIALIQNSDTTLELSVMPKDEDILQVLQFTKDVTALAYSQDAYLKGNEAYSGNARNIPEPPPICYPWLPSAPSAMAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSQFKKIPPDLKTLQSNRNFQTTCGMSLPRGISQDRSPLVKVRSNSLKAPSTHVTKPSFSQKSFVSIKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIM

SEQ ID NO: 61701 - protein, 1407 aa, Homo sapiens
MATRRTGLSEGDGDKLKACEVSKNKDGKEQSETVSLSEDETFSWPGPKTVTLKRTSQGFGFTLRHFIVYPPESAIQFSYKDEENGNRGGKQRNRLEPMDTIFVKQVKEGGPAFEAGLCTGDRIIKVNGESVIGKTYSQVIALIQNSDTTLELSVMPKDEDILQVAYSQDAYLKGNEAYSGNARNIPEPPPICYPWLPSAPSAMAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSHWRKGIPSIMRKTFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGSKAEFHPCL

SEQ ID NO: 61702 - protein, 92 aa, Homo sapiens
MDTIFVKQVKEGGPAFEAGLCTGDRIIKVNGESVIGKTYSQVIALIQNSDTTLELSVMPKDEDILQVNLEFSTFYKNTIAKFLQLSDMEMLC

SEQ ID NO: 61703 - protein, 1491 aa, Homo sapiens
MNGVAFCLVGIPPRPEPRPPQLPLGPRDGCSPRRPFPWQGPRTLLLYKSPQDGFGFTLRHFIVYPPESAVHCSLKEEENGGRGGGPSPRYRLEPMDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYAPPARASTRATMVPEPTSALPSDPRSPAAWSDPGLRVPPAARAHLDNSSLGMSQPRPSPGAFPHLSSEPRTPRAFPEPGSRVPPSRLECQQALSHWLSNQVPRRAGERRCPAMAPRARSASQDRLEEVAAPRPWPCSTSQDALSQLGQEGWHRARSDDYLSRATRSAEALGPGALVSPRFERCGWASQRSSARTPACPTRDLPGPQAPPPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSDSTTCSSAKSKGSWAPKKEPYAREMLAISFISAVNRKRKKRREARGLGSSTDDDSEQEAHKPGAGATAPGTQERPQGPLPGAVAPEAPGRLSPPAAPEERPAADTRSIVSGYSTLSTMDRSVCSGASGRRAGAGDEADDERSELSHVETDTEGAAGAGPGGRLTRRPSFSSHHLMPCDTLARRRLARGRPDGEGAGRGGPRAPEPPGSASSSSQESLRPPAAALASRPSRMEALRLRLRGTADDMLAVRLRRPLSPETRRRRSSWRRHTVVVQSPLTDLNFNEWKELGGGGPPEPAGARAHSDNKDSGLSSLESTKARAPSSAASQPPAPGDTGSLQSQPPRRSAASRLHQCL

SEQ ID NO: 61704 - protein, 1144 aa, Homo sapiens
MNGVAFCLVGIPPRPEPRPPQLPLGPRDGCSPRRPFPWQGPRTLLLYKSPQDGFGFTLRHFIVYPPESAVHCSLKEEENGGRGGGPSPRYRLEPMDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYAPPARASTRATMVPEPTSALPSDPRSPAAWSDPGLRVPPAARAHLDNSSLGMSQPRPSPGAFPHLSSEPRTPRAFPEPGSRVPPSRLECQQALSHWLSNQVPRRAGERRCPAMAPRARSASQDRLEEVAAPRPWPCSTSQDALSQLGQEGWHRARSDDYLSRATRSAEALGPGALVSPRFERCGWASQRSSARTPACPTRDLPGPQAPPPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSADLLEI

SEQ ID NO: 61705 - protein, 1397 aa, Homo sapiens
MDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYAPPARASTRATMVPEPTSALPSDPRSPAAWSDPGLRVPPAARAHLDNSSLGMSQPRPSPGAFPHLSSEPRTPRAFPEPGSRVPPSRLECQQALSHWLSNQVPRRAGERRCPAMAPRARSASQDRLEEVAAPRPWPCSTSQDALSQLGQEGWHRARSDDYLSRATRSAEALGPGALVSPRFERCGWASQRSSARTPACPTRDLPGPQAPPPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSDSTTCSSAKSKGSWAPKKEPYAREMLAISFISAVNRKRKKRREARGLGSSTDDDSEQEAHKPGAGATAPGTQERPQGPLPGAVAPEAPGRLSPPAAPEERPAADTRSIVSGYSTLSTMDRSVCSGASGRRAGAGDEADDERSELSHVETDTEGAAGAGPGGRLTRRPSFSSHHLMPCDTLARRRLARGRPDGEGAGRGGPRAPEPPGSASSSSQESLRPPAAALASRPSRMEALRLRLRGTADDMLAVRLRRPLSPETRRRRSSWRRHTVVVQSPLTDLNFNEWKELGGGGPPEPAGARAHSDNKDSGLSSLESTKARAPSSAASQPPAPGDTGSLQSQPPRRSAASRLHQCL

SEQ ID NO: 61706 - protein, 655 aa, Homo sapiens
MPEDRNSGGCPAGALASTPFIPKTTYRRIKRCFSFRKGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 61707 - protein, 653 aa, Homo sapiens
MTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 61708 - protein, 748 aa, Homo sapiens
MEENNDSTENPQQGQGRQNAIKCGWLRKQGGFVKTWHTRWFVLKGDQLYYFKDEDETKPLGTIFLPGNKVSEHPCNEENPGKFLFEVVPGGDRDRMTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 61709 - protein, 246 aa, Homo sapiens
MEENNDSTENPQQGQGRQNAIKCGWLRKQGGFVKTWHTRWFVLKGDQLYYFKDEDETKPLGTIFLPGNKVSEHPCNEENPGKFLFEVVPGGDRDRMTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAVS

SEQ ID NO: 61710 - protein, 82 aa, Homo sapiens
MTANHESYLLMASTQNDMEDWVKSIRRVIWGPFGGGIFGQKLEDTVRYEKRYGNRLAPMLVEQCVDFIRQRGLKEEGLFRLP

SEQ ID NO: 61711 - protein, 645 aa, Homo sapiens
MSLKLPRNWDFNLKVEAAKIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 61712 - protein, 638 aa, Homo sapiens
MSLGQSACLFLSIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 61713 - protein, 646 aa, Homo sapiens
MSLKLPRNWDFNLKVEAAKIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 61714 - protein, 639 aa, Homo sapiens
MSLGQSACLFLSIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 61715 - protein, 283 aa, Homo sapiens
MTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKNYRNRNDCQSVVSAQIHQFCPRVSLLAHGQAHLLVNDLLV

SEQ ID NO: 61716 - protein, 591 aa, Homo sapiens
MSLGQSACLFLSIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRPFLSAI

SEQ ID NO: 61717 - protein, 458 aa, Homo sapiens
MSLGQSACLFLSIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMVRCREPSCFHWVLPLVQAIPCKACSRVAIWGVLGDAVAVGAAATDSSEHTLKAWPLSKSSFYWHL

SEQ ID NO: 61718 - protein, 630 aa, Homo sapiens
MSLGQSACLFLSIARSRSVMTGEQMAAFHPSSTPNPLERPIKMGWLKKQRSIVKNWQQSYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 61719 - protein, 283 aa, Homo sapiens; identical to SEQ ID NO: 61715

SEQ ID NO: 61720 - protein, 606 aa, Homo sapiens
MSLKLPRNWDFNLKVEAAKIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 61721 - protein, 814 aa, Homo sapiens
MGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVRSVAGFVWFSVAAVVLSLARSSLHAVFSLLVNFVPCHPNLHLLFDRPEEAVHEDSSTPFRKAKALYACKAEHDSELSFTAGTVFDNVHPSQEPGWLEGTLNGKTGLIPENYVEFL

SEQ ID NO: 61722 - protein, 759 aa, Homo sapiens
MGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVSTPFRKAKALYACKAEHDSELSFTAGTVFDNVHPSQEPGWLEGTLNGKTGLIPENYVEFL

SEQ ID NO: 61723 - protein, 294 aa, Homo sapiens
  MOD_RES (1)..(1): Any amino acid
XPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLTPFRKAKALYACKAEHDSELSFTAGTVFDNVHPSQEPGWLEGTLNGKTGLIPENYVEFL

SEQ ID NO: 61724 - protein, 286 aa, Homo sapiens
MDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPRITWSSSNRGPQQNC

SEQ ID NO: 61725 - protein, 388 aa, Homo sapiens
  MOD_RES (1)..(1): Any amino acid
XAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVRPEEAVHEDSSTPFRKAKALYACKAEHDSELSFTAGTVFDNVHPSQEPGWLEGTLNGKTGLIPENYVEFL

SEQ ID NO: 61726 - protein, 263 aa, Homo sapiens
MAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRASSLCGPAQRGAATQRSSLAPGLPACLYLRPAAPVRPAQSLNDLACAAVSPPAGLLGSSGSFKACSVAGSWVCPRPLARSDSENVYEVIQDLHVPPPEESAEQVPPRALGRGGGWRARDRARTEPGRKETRSAQRRARRPPLSEDFG

SEQ ID NO: 61727 - protein, 548 aa, Homo sapiens
MQPGLSPGSPGDPRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 61728 - protein, 889 aa, Homo sapiens
MAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRASSLCGPAQRGAATQRSSLAPGLPACLYLRPAAPVRPAQSLNDLACAAVSPPAGLLGSSGSFKACSVAGSWVCPRPLARSDSENVYEVIQDLHVPPPEESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 61729 - protein, 862 aa, Homo sapiens
MAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRASSLCGPAQRGAATQRSSLAPGLPACLYLRPAAPVRPAQSLNDLACAAVSPPAGLLGSSGSFKACSVAGSWVCPRPLARSDSENVYEVIQDLHVPPPEESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRPPTPETDYPESLTSYPEEDYSPVGSFGEPGPTSPLTTPPGWSCHVSQDKQMLYTNHFTQEQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 61730 - protein, 548 aa, Homo sapiens; identical to SEQ ID NO: 61727

SEQ ID NO: 61731 - protein, 263 aa, Homo sapiens; identical to SEQ ID NO: 61726

SEQ ID NO: 61732 - protein, 521 aa, Homo sapiens
MQPGLSPGSPGDPRPPTPETDYPESLTSYPEEDYSPVGSFGEPGPTSPLTTPPGWSCHVSQDKQMLYTNHFTQEQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 61733 - protein, 670 aa, Homo sapiens
MLSNESLHPPAFSRSNSEASVDSASMEDFWREIESIKDSSMGGQEEPPPAEVTPVDEGELEAEWLQDVGLSTLISGDEEEDGKALLSTLTRTQAAAVQKRYHTYTQTMRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENRILHWQRAALSFLNGKWVKKEREESTETNRSPKHVFLFTIGLDIST

SEQ ID NO: 61734 - protein, 570 aa, Homo sapiens
MRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENSHGSSECIKIQNQRLYEIGGNIGEHCLDPDAYILDVYRINPQAEWVIKPQQSS

SEQ ID NO: 61735 - protein, 545 aa, Homo sapiens
MNELPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENRILHWQRAALSFLNGKWVKKEREESTETNRSPKHVFLFTIGLDIST

SEQ ID NO: 61736 - protein, 722 aa, Homo sapiens
MEVEDSGGVVLTAYHSYARAQPPNAESRCAPRAAASHPLSRKSIPRCRRINRMLSNESLHPPAFSRSNSEASVDSASMEDFWREIESIKDSSMGGQEEPPPAEVTPVDEGELEAEWLQDVGLSTLISGDEEEDGKALLSTLTRTQAAAVQKRYHTYTQTMRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENRILHWQRAALSFLNGKWVKKEREESTETNRSPKHVFLFTIGLDIST

SEQ ID NO: 61737 - protein, 563 aa, Homo sapiens
MRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENRILHWQRAALSFLNGKWVKKEREESTETNRSPKHVFLFTIGLDIST

SEQ ID NO: 61738 - protein, 570 aa, Homo sapiens; identical to SEQ ID NO: 61734

SEQ ID NO: 61739 - protein, 117 aa, Homo sapiens
MLSNESLHPPAFSRSNSEASVDSASMEDFWREIESIKDSSMGGQEEPPPAEVTPVDEGELEAEWLQDVGLSTLISGDEEEDGKALLSTLTRTQAAAVQKRYHTYTQTMRKKDKQSIR

SEQ ID NO: 61740 - protein, 554 aa, Homo sapiens
MAFMRINVIMNELPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENRILHWQRAALSFLNGKWVKKEREESTETNRSPKHVFLFTIGLDIST

SEQ ID NO: 61741 - protein, 1261 aa, Homo sapiens
MIAHKQKKTKKKRAWASGQLSTDITTSEMGLKSLSSNSIFDPDYIKELVNDIRKFSHMLLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVEEANELYKVCVTNVEERRNDLENTKREILAQLRTLVFQCDLTLKAVTVNLFHMQHLQAASLADSLQSLCDSAKLYDPGQEYSEFVKATNSTEEEKVDGNVNKHLNSSQPSGFGPANSLEDVVRLPDSSNKIEEDRCSNSADITGPSFIRSWTFGMFSDSESTGGSSESRSLDSESISPGDFHRKLPRTPSSGTMSSADDLDEREPPSPSETGPNSLGTFKKTLMSKAALTHKFRKLRSPTKCRDCEGIVVFQGVECEECLLVCHRKCLENLVIICGHQKLPGKIHLFGAEFTQVAKKEPDGIPFILKICASEIENRALCLQGIYRVCGNKIKTEKLCQALENGMHLVDISEFSSHDICDVLKLYLRQLPEPFILFRLYKEFIDLAKEIQHVNEEQETKKNSLEDKKWPNMCIEINRILLKSKDLLRQLPASNFNSLHFLIVHLKRVVDHAEENKMNSKNLGVIFGPSLIRPRPTTAPITISSLAEYSNQARLVEFLITYSQKIFDGSLQPQDVMCSIGVVDQGCFPKPLLSPEERDIERSMKSLFFSSKEDIHTSESESKIFERATSFEESERKQNALGKCDACLSDKAQLLLDQEAESASQKIEDGKTPKPLSLKSDRSTNNVERHTPRTKIRPVSLPVDRLLLASPPNERNGRNMGNVNLDKFCKNPAFEGVNRKDAATTVCSKFNGFDQQTLQKIQDKQYEQNSLTAKTTMIMPSALQEKGVTTSLQISGDHSINATQPSKPYAEPVRSVREASERRSSDSYPLAPVRAPRTLQPQHWTTFYKPHAPIISIRGNEEKPASPSAAVPPGTDHDPHGLVVKSMPDPDKASACPGQATGQPKEDSEELGLPDVNPMCQRPRLKRMQQFEDLEGEIPQFV

SEQ ID NO: 61742 - protein, 393 aa, Homo sapiens
MIAHKQKKTKKKRAWASGQLSTDITTSEMGLKSLSSNSIFDPDYIKELVNDIRKFSHMLLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVTIFFFFICKLN

SEQ ID NO: 61743 - protein, 1101 aa, Homo sapiens
MKSRQKGKKKGSAKERVFGCDLQEHLQHSGQEVPQVLKSCAEFVEEYGVVDGIYRLSGVSSNIQKLRQEFESERKPDLRRDVYLQDIHCVSSLCKAYFRELPDPLLTYRLYDKFAEAVGVQLEPERLVKILEVLRELPVPNYRTLEFLMRHLVHMASFSAQTNMHARNLAIVWAPNLLRSKDIEASGFNGTAAFMEVRVQSIVVEFILTHVDQLFGGAALSGGEVESGWRSLPGTRASGSPEDLMPRPLPYHLPSILQAGDGPPQMRPYHTIIEIAEHKRKGSLKVRKWRSIFNLGRSGHETKRKLPRGAEDREDKSNKGTLRPAKSMDSLSAAAGASDEPEGLVGPSSPRPSPLLPESLENDSIEAAEGEQEPEAEALGGTNSEPGTPRAGRSAIRAGGSSRAERCAGVHISDPYNVNLPLHITSILSVPPNIISNVSLARLTRGLECPALQHRPSPASGPGPGPGLGPGPPDEKLEASPASSPLADSGPDDLAPALEDSLSQEVQDSFSFLEDSSSSEPEWVGAEDGEVAQAEAAGAAFSPGEDDPGMGYLEELLGVGPQVEEFSVEPPLDDLSLDEAQFVLAPSCCSLDSAGPRPEVEEENGEEVFLSAYDDLSPLLGPKPPIWKGSGSLEGEAAGCGRQALGQGGEEQACWEVGEDKQAEPGGRLDIREEAEGSPETKVEAGKASEDRGEAGGSQETKVRLREGSREETEAKEEKSKGQKKADSMEAKGVEEPGGDEYTDEKEKEIEREEDEQREEAQVEAGRDLEQGAQEDQVAEEKWEVVQKQEAEGVREDEDKGQREKGYHEARKDQGDGEDSRSPEAATEGGAGEVSKERESGDGEAEGDQRAGGYYLEEDTLSEGSGVASLEVDCAKEGNPHSSEMEEVAPQPPQPEEMEPEGQPSPDGCLCPCSLGLGGVGMRLASTLVQVQQVRSVPVVPPKPQFAKMPSAMCSKIHVAPANPCPRPGRLDGTPGERAWGSRASRSSWRNGGSLSFDAAVALARDRQRTEAQGVRRTQTCTEGGDYCLIPRTSPCSMISAHSPRPLSCLELPSEGAEGSGSRSRLSLPPREPQVPDPLLSSQRRSYAFETQANPGKGEGL

SEQ ID NO: 61744 - protein, 890 aa, Homo sapiens
MKSRQKGKKKGSAKERVFGCDLQEHLQHSGQEVPQVLKSCAEFVEEYGVVDGIYRLSGVSSNIQKLRQEFESERKPDLRRDVYLQDIHCVSSLCKAYFRELPDPLLTYRLYDKFAEAVGVQLEPERLVKILEVLRELPVPNYRTLEFLMRHLVHMASFSAQTNMHARNLAIVWAPNLLRSKDIEASGFNGTAAFMEVRVQSIVVEFILTHVDQLFGGAALSGGEVESGWRSLPGTRASGSPEDLMPRPLPYHLPSILQAGDGPPQMRPYHTIIEIAEHKRKGSLKVRKWRSIFNLGRSGHETKRKLPRGAEDREDKSNKGTLRPAKSMDSLSAAAGASDEPEGLVGPSSPRPSPLLPESLENDSIEAAEGEQEPEAEALGGTNSEPGTPRAGRSAIRAGGSSRAERCAGVHISDPYNVNLPLHITSILSVPPNIISNVSLARLTRGLECPALQHRPSPASGPGPGPGLGPGPPDEKLEASPASSPLADSGPDDLAPALEDSLSQEVQDSFSFLEDSSSSEPEWVGAEDGEVAQAEAAGAAFSPGEDDPGMGYLEELLGVGPQVEEFSVEPPLDDLSLDEAQFVLAPSCCSLDSAGPRPEVEEENGEEVFLSAYDDLSPLLGPKPPIWKGSGSLEGEAAGCGRQALGQGGEEQACWEVGEDKQAEPGGRLDIREEAEGTPQPPQPEEMEPEGQPSPDGCLCPCSLGLGGVGMRLASTLVQVQQVRSVPVVPPKPQFAKMPSAMCSKIHVAPANPCPRPGRLDGTPGERAWGSRASRSSWRNGGSLSFDAAVALARDRQRTEAQGVRRTQTCTEGGDYCLIPRTSPCSMISAHSPRPLSCLELPSEGAEGSGSRSRLSLPPREPQVPDPLLSSQRRSYAFETQANPGKGEGL

SEQ ID NO: 61745 - protein, 499 aa, Homo sapiens
MRHLVHMASFSAQTNMHARNLAIVWAPNLLRSKDIEASGFNGTAAFMEVRVQSIVVEFILTHVDQLFGGAALSGGEVESGWRSLPGTRASGSPEDLMPRPLPYHLPSILQAGDGPPQMRPYHTIIEIAEHKRKGSLKVRKWRSIFNLGRSGHETKRKLPRGAEDREDKSNKGTLRPAKSMDSLSAAAGASDEPEGLVGPSSPRPSPLLPESLENDSIEAAEGEQEPEAEALGGTNSEPGTPRAGRSAIRAGGSSRAERCAGVHISDPYNVNLPLHITSILSVPPNIISNVSLARLTRGLECPALQHRPSPASGPGPGPGLGPGPPDEKLEASPASSPLADSGPDDLAPALEDSLSQEVQDSFSFLEDSSSSEPEWVGAEDGEVAQAEAAGAAFSPGEDDPGMGYLEELLGVGPQVEEFSVEPPLDDLSLDEAQFVLAPSCCSLDSAGPRPEVEEENGEEVFLSAYDDLSPALGLLLQPGWGHRSHSSEGQCLRIKAVFL

SEQ ID NO: 61746 - protein, 1444 aa, Homo sapiens
MKNKGAKQKLKRKGAASAFGCDLTEYLESSGQDVPYVLKSCAEFIETHGIVDGIYRLSGVTSNIQRLRQEFGSDQCPDLTREVYLQDIHCVGSLCKLYFRELPNPLLTYELYEKFTEAVSHCPEEGQLARIQNVIQELPPSHYRTLEYLIRHLAHIASFSSKTNMHARNLALVWAPNLLRSKEIEATGCNGDAAFLAVRVQQVVIEFILNHVDQIFNNGAPGSLENDENRPIMKSLTLPALSLPMKLVSLEEAQARSLATNHPARKERRENSLPEIVPPMGTLFHTVLELPDNKRKLSSKSKKWKSIFNLGRSGSDSKSKLSRNGSVFVRGQRLSVEKATIRPAKSMDSLCSVPVEGKETKGNFNRTVTTGGFFIPATKMHSTGTGSSCDLTKQEGEWGQEGMPPGAEGGFDVSSDRSHLQGAQARPPPEQLKVFRPVEDPESEQTAPKMLGMFYTSNDSPSKSVFTSSLFQMEPSPRNQRKALNISEPFAVSVPLRVSAVISTNSTPCRTPPKELQSLSSLEEFSFHGSESGGWPEEEKPLGAETSAASVPKKAGLEDAKAVPEAPGTVECSKGLSQEPGAHLEEKKTPESSLSSQHLNELEKRPNPEKVVEEGREAGEMESSTLQESPRARAEAVLLHEMDEDDLANALIWPEIQQELKIIESEEELSSLPPPALKTSPIQPILESSLGPFIPSEPPGSLPCGSFPAPVSTPLEVWTRDPANQSTQGASTAASREKPEPEQGLHPDLASLAPLEIVPFEKASPQATVEVGGPGNLSPPLPPAPPPPTPLEESTPVLLSKGGPEREDSSRKLRTDLYIDQLKSQDSPEISSLCQGEEATPRHSDKQNSKNAASEGKGCGFPSPTREVEIVSQEEEDVTHSVQEPSDCDEDDTVTDIAQHGLEMVEPWEEPQWVTSPLHSPTLKDAHKAQVQGLQGHQLEKRLSHRPSLRQSHSLDSKPTVKSQWTLEVPSSSSCANLETERNSDPLQPQAPRREITGWDEKALRSFREFSGLKGAEAPPNQKGPSGVQPNPAETSPISLAEGKELGTHLGHSSPQIRQGGVPGPESSKESSPSVQDSTSPGEHPAKLQLKSTECGPPKGKNRPSSLNLDPAIPIADLFWFENVASFSSPGMQVSEPGDPKVTWMTSSYCKADPWRVYSQDPQDLDIVAHALTGRRNSAPVSVSAVRTSFMVKMCQARAVPVIPPKIQYTQIPQPLPSQSSGENGVQPLERSQEGPSSTSGTTQKPAKDDSPSSLESSKEEKPKQDPGAIKSSPVDATAPCMCEGPTLSPEPGSSNLLSTQDAVVQCRKRMSETEPSGDNLLSSKLERPSGGSKPFHRSRPGRPQSLILFSPPFPIMDHLPPSSTVTDSKVLLSPIRSPTQTVSPGLLCGELAENTWVTPEGVTLRNKMTIPKNGQRLETSTSCFYQPQRRSVILDGRSGRQIE

SEQ ID NO: 61747 - protein, 1099 aa, Homo sapiens
MKNKGAKQKLKRKGAASAFGCDLTEYLESSGQDVPYVLKSCAEFIETHGIVDGIYRLSGVTSNIQRLRQEFGSDQCPDLTREVYLQDIHCVGSLCKLYFRELPNPLLTYELYEKFTEAVSHCPEEGQLARIQNVIQELPPSHYRTLEYLIRHLAHIASFSSKTNMHARNLALVWAPNLLRSKEIEATGCNGDAAFLAVRVQQVVIEFILNHVDQIFNNGAPGSLENDENRPIMKSLTLPALSLPMKLVSLEEAQARSLATNHPARKERRENSLPEIVPPMGTLFHTVLELPDNKRKLSSKSKKWKSIFNLGRSGSDSKSKLSRNGSVFVRGQRLSVEKATIRPAKSMDSLCSVPVEGKETKGNFNRTVTTGGFFIPATKMHSTGTGSSCDLTKQEGEWGQEGMPPGAEGGFDVSSDRSHLQGAQARPPPEQLKVFRPVEDPESEQTAPKMLGMFYTSNDSPSKSVFTSSLFQMEPSPRNQRKALNISEPFAVSVPLRVSAVISTNSTPCRTPPKELQSLSSLEEFSFHGSESGGWPEEEKPLGAETSAASVPKKAGLEDAKAVPEAPGTVECSKGLSQEPGAHLEEKKTPESSLSSQHLNELEKRPNPEKVVEEGREAGEMESSTLQESPRARAEAVLLHEMDEDDLANALIWPEIQQELKIIESEEELSSLPPPALKTSPIQPILESSLGPFIPSEPPGSLPCGSFPAPVSTPLEVWTRDPANQSTQGASTAASREKPEPEQGLHPDLASLAPLEIVPFEKASPQATVEVGGPGNLSPPLPPAPPPPTPLEESTPVLLSKGGPEREDSSRKLRTDLYIDQLKSQDSPEISSLCQGEEATPRHSDKQNSKNAASEGKGCGFPSPTREVEIVSQEEEDVTHSVQEPSDCDEDDTVTDIAQHGLEMVEPWEEPQWVTSPLHSPTLKDAHKAQVQGLQGHQLEKRLSHRPSLRQSHSLDSKPTVKSQWTLEVPSSSSCANLETERNSDPLQPQAPRREITGWDEKALRSFREFSGLKGAEAPPNQKGPSGVQPNPAQPVGPLRNLPKMILPPPWKAQRKKNQSKIPEPLSPHQWMPLHPACARDLPFLQNQARLTCSPPRMQ

SEQ ID NO: 61748 - protein, 1502 aa, Homo sapiens
MMAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGLEQDFEQKQMPEGKLNVDGFLLCIDVSQGCNRKFDDQLKFVNNLFVQLSKSKKPVIIAATKCDECVDHYLREVQAFASNKKNLLVVETSARFNVNIETCFTALVQMLDKTRSKPKIIPYLDAYKTQRQLVVTATDKFEKLVQTVRDYHATWKTVSNKLKNHPDYEEYINLEGTRKARNTFSKHIEQLKQEHIRKRREEYINTLPRAFNTLLPNLEEIEHLNWSEALKLMEKRADFQLCFVVLEKTPWDETDHIDKINDRRIPFDLLSTLEAEKVYQNHVQHLISEKRRVEMKEKFKKTLEKIQFISPGQPWEEVMCFVMEDEAYKYITEADSKEVYGRHQREIVEKAKEEFQEMLFEHSELFYDLDLNATPSSDKMSEIHTVLSEEPRYKALQKLAPDRESLLLKHIGFVYHPTKETCLSGQNCTDIKVEQLLASSLLQLDHGRLRLYHDSTNIDKVNLFILGKDGLAQELANEIRTQSTDDEYALDGKIYELDLRPVDAKSPYFLSQLWTAAFKPHGCFCVFNSIESLSFIGEFIGKIRTEASQIRKDKYMANLPFTLILANQRDSISKNLPILRHQGQQLANKLQCPFVDVPAGTYPRKFNETQIKQALRGVLESVKHNLDVVSPIPANKDLSEADLRIVMCAMCGDPFSVDLILSPFLDSHSCSAAQAGQNNSLMLDKIIGEKRRRIQITILSYHSSIGVRKDELVHGYILVYSAKRKASMGMLRAFLSEVQDTIPVQLVAVTDSQADFFENEAIKELMTEGEHIATEITAKFTALYSLSQYHRQTEVFTLFFSDVLEKKNMIENSYLSDNTRESTHQSEDVFLPSPRDCFPYNNYPDSDDDTEAPPPYSPIGDDVQLLPTPSDRSRYRLDLEGNEYPIHSTPNCHDHERNHKVPPPIKPKPVVPKTNVKKLDPNLLKTIEAGIGKNPRKQTSRVPLAHPEDMDPSDNYAEPIDTIFKQKGYSDEIYVVPDDSQNRIKIRNSFVNNTQGDEENGFSDRTSKSHGERRPSKYKYKSKTLFSKAKSYYRRTHSDASDDEAFTTSKTKRKGRHRGSEEDPLLSPVETWKGGIDNPAITSDQELDDKKMKKKTHKVKEDKKQKKKTKNFNPPTRRNWESNYFGMPLQDLVTAEKPIPLFVEKCVEFIEDTGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQHKINLMTADNLSICFWPTLMRPDFENREFLSTTKIHQSVVETFIQQCQFFFYNGEIVETTNIVAPPPPSNPGQLVEPMVPLQLPPPLQPQLIQPQLQTDPLGII

SEQ ID NO: 61749 - protein, 237 aa, Homo sapiens
MSLPPPPPGPLPLRRRRRRPTLLGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQHKINLMTADNLSICFWPTLMRPDFENREFLSTTKIHQSVVETFIQQCQFFFYNGEIVETTNIVAPPPPSNPGQLVEPMVPLQLPPPLQPQLIQPQLQTDPLGII

SEQ ID NO: 61750 - protein, 1501 aa, Homo sapiens
MMAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGLEQDFEQKQMPEGKLNVDGFLLCIDVSQGCNRKFDDQLKFVNNLFVQLSKSKKPVIIAATKCDECVDHYLREVQAFASNKKNLLVVETSARFNVNIETCFTALVQMLDKTRSKPKIIPYLDAYKTQRQLVVTATDKFEKLVQTVRDYHATWKTVSNKLKNHPDYEEYINLEGTRKARNTFSKHIEQLKQEHIRKRREEYINTLPRAFNTLLPNLEEIEHLNWSEALKLMEKRADFQLCFVVLEKTPWDETDHIDKINDRRIPFDLLSTLEAEKVYQNHVQHLISEKRRVEMKEKFKKTLEKIQFISPGQPWEEVMCFVMEDEAYKYITEADSKEVYGRHQREIVEKAKEEFQEMLFEHSELFYDLDLNATPSSDKMSEIHTVLSEEPRYKALQKLAPDRESLLLKHIGFVYHPTKETCLSGQNCTDIKVEQLLASSLLQLDHGRLRLYHDSTNIDKVNLFILGKDGLAQELANEIRTQSTDDEYALDGKIYELDLRPVDAKSPYFLSQLWTAAFKPHGCFCVFNSIESLSFIGEFIGKIRTEASQIRKDKYMANLPFTLILANQRDSISKNLPILRHQGQQLANKLQCPFVDVPAGTYPRKFNETQIKQALRGVLESVKHNLDVVSPIPANKDLSEADLRIVMCAMCGDPFSVDLILSPFLDSHSCSAAQAGQNNSLMLDKIIGEKRRRIQITILSYHSSIGVRKDELVHGYILVYSAKRKASMGMLRAFLSEVQDTIPVQLVAVTDSQADFFENEAIKELMTEGEHIATEITAKFTALYSLSQYHRQTEVFTLFFSDVLEKKNMIENSYLSDNTRESTHQSEDVFLPSPRDCFPYNNYPDSDDDTEAPPPYSPIGDDVQLLPTPSDRSRYRLDLEGNEYPIHSTPNCHDHERNHKVPPPIKPKPVVPKTNVKKLDPNLLKTIEAGIGKNPRKQTSRVPLAHPEDMDPSDNYAEPIDTIFKQKGYSDEIYVVPDDSQNRIKIRNSFVNNTQGDEENGFSDRTSKSHGERRPSKYKYKSKTLFSKAKSYYRRTHSDASDDEAFTTSKTKRKGRHRGSEEDPLLSPVETWKGGIDNPAITSDQELDDKKMKKKTHKVKEDKKKKKTKNFNPPTRRNWESNYFGMPLQDLVTAEKPIPLFVEKCVEFIEDTGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQHKINLMTADNLSICFWPTLMRPDFENREFLSTTKIHQSVVETFIQQCQFFFYNGEIVETTNIVAPPPPSNPGQLVEPMVPLQLPPPLQPQLIQPQLQTDPLGII

SEQ ID NO: 61751 - protein, 241 aa, Homo sapiens
MPLQDLVTAEKPIPLFVEKCVEFIEDTGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQHKINLMTADNLSICFWPTLMRPDFENREFLSTTKIHQSVVETFIQQCQFFFYNGEIVETTNIVAPPPPSNPGQLVEPMVPLQLPPPLQPQLIQPQLQTDPLGII

SEQ ID NO: 61752 - protein, 1502 aa, Homo sapiens; identical to SEQ ID NO: 61748

SEQ ID NO: 61753 - protein, 137 aa, Homo sapiens
MPLQDLVTAEKPIPLFVEKCVEFIEDTGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQ

SEQ ID NO: 61754 - protein, 37 aa, Homo sapiens
MMAKNKEPRPPSYTISIVGLSGTEKDKGNCGVGKSCL

SEQ ID NO: 61755 - protein, 140 aa, Homo sapiens
MMAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGL

SEQ ID NO: 61756 - protein, 1501 aa, Homo sapiens; identical to SEQ ID NO: 61750

SEQ ID NO: 61757 - protein, 771 aa, Homo sapiens
MSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGSSGDIFESSSLRAGPCSLSQGNLSPNWPRWQGSPAELDSDTQGARRTQAAAPATEGRAHPAVSRACSTPHVQVAGKAERPTARSEQYLTLSGAHDLSESELDVAGLQSRATPQCQRPHGSGRDDKRPPPPYPGPGKPAAAAAWIQGPPEGVETPTDQGGQAAEREQQVTQKKLSSANSLPAGEQDSPRLGDAGWLDWQRERWQIWELLSTDNPDALPETLV

SEQ ID NO: 61758 - protein, 974 aa, Homo sapiens
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSEGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGSSGDIFESSSLRAGPCSLSQGNLSPNWPRWQGSPAELDSDTQGARRTQAAAPATEGRAHPAVSRACSTPHVQVAGKAERPTARSEQYLTLSGAHDLSESELDVAGLQSRATPQCQRPHGSGRDDKRPPPPYPGPGKPAAAAAWIQGPPEGVETPTDQGGQAAEREQQVTQKKLSSANSLPAGEQDSPRLGDAGWLDWQRERWQIWELLSTDNPDALPETLV

SEQ ID NO: 61759 - protein, 601 aa, Homo sapiens
LELYDLQILGTKPPMNSDTHRNFDPTATLRNQGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKGNWSLASRRWPKQATLLLLHVAWCGALRTFSSSLPYLMFL

SEQ ID NO: 61760 - protein, 765 aa, Homo sapiens
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSEGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKGNWSLASRRWPKQATLLLLHVAWCGALRTFSSSLPYLMFL

SEQ ID NO: 61761 - protein, 690 aa, Homo sapiens
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSELELYDLQILGTKPPMNSDTHRNFDPTATLRNQGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSTSSVLPAAVQACPQYPASMFTP

SEQ ID NO: 61762 - protein, 771 aa, Homo sapiens; identical to SEQ ID NO: 61757

SEQ ID NO: 61763 - protein, 467 aa, Homo sapiens [sequence omitted]

SEQ ID NO: 61764 - protein, 604 aa, Homo sapiens
MKRLHIFGPKIHSSGGLWQQKGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGTTPLLNISSQEDHRQKDLRLIFKIYP

SEQ ID NO: 61765 - protein, 305 aa, Homo sapiens
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVPGEHLQQNEQL

SEQ ID NO: 61766 - protein, 433 aa, Homo sapiens
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 61767 - protein, 555 aa, Homo sapiens
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEELQRDKAAAAAVLGAVRKRPSVVPMAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 61768 - protein, 464 aa, Homo sapiens
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKDGDLTMWPRLVSNSKLKRSSHLSLPKYWDYRYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 61769 - protein, 130 aa, Homo sapiens
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKDGDLTMWPRLVSNSKLKRSSHLSLPKYWDY

SEQ ID NO: 61770 - protein, 115 aa, Homo sapiens
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTS

SEQ ID NO: 61771 - protein, 643 aa, Homo sapiens
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILELQRDKAAAAAVLGAVRKRPSVVPMAGQDPALSTSHPFYDVARHGILQVAGDDRFGRRVVTFSCCRMPPSHELDHQRLLEYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 61772 - protein, 773 aa, Homo sapiens
QTQTESLTLCSGEAERRGKEEWPDSHHYPGPTPAPESSDGPHKVTVLATMLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALALSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 61773 - protein, 750 aa, Homo sapiens
MLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLVRWVEARREAPTGRDQGSGDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 61774 - protein, 731 aa, Homo sapiens
MLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 61775 - protein, 821 aa, Homo sapiens
MRRGSSDSCASGSQVAGTTVAGPAHPESLTLCSGEAERRGKEEWPDSHHYPGPTPAPESSDGPHKVTVLATMLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLVRWVEARREAPTGRDQGSGDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 61776 - protein, 299 aa, Homo sapiens
MTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQALSESEQCLSQIQELIGSMPKPNHDTLRYLLEHLC

SEQ ID NO: 61777 - protein, 640 aa, Homo sapiens
MLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALG

SEQ ID NO: 61778 - protein, 547 aa, Homo sapiens
MSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 61779 - protein, 297 aa, Homo sapiens
MSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSS

SEQ ID NO: 61780 - protein, 61 aa, Homo sapiens
MSEPPVYCNLVDLRRCPRSPPPGPACPLLQRLDAWEQHLDPNSGRCFYINSLTGCKSWKPP

SEQ ID NO: 61781 - protein, 156 aa, Homo sapiens
  MOD_RES (1)..(1): Any amino acid
XEGDTVPSFLRLCIAAVDKRGLDVDGIYRVSGNLAVVQKLRFLVDRERAVTSDGRYVFPEQPGQALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 61782 - protein, 131 aa, Homo sapiens
MSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQ

SEQ ID NO: 61783 - protein, 675 aa, Homo sapiens
EPGSGSRDPGPGIAEPDLGRPAGHLRADTSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETERCPGWGAGAGGVAYWALVGGCRVTAAICACLSQALAPHAPLLLSGSGHSSPFFFPFLISLLLPHCPPFLLSFLFPLLLPLLPFFTNPSPPPFLSTTPSISFISSPLLSHLPPPLFPPHSSLTWVFFPHLPSPSDLPATFHFFSPSPFSFKPPCPLPPTPRLAPASWCPSLNPPPLCSVPWGPCPPYSWGAGSASCPSLCRCFGDPLVGAGRWVRFHLGPPLTLCPSLPRRWKRWVPGPWVGEGLAPPPFLPAPPLSPWPLPPLHSL

SEQ ID NO: 61784 - protein, 927 aa, Homo sapiens
MASLSTWSSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 61785 - protein, 879 aa, Homo sapiens
MEDFARGAASPGPSRPGLVPVSIIGAEDEDFENELETNSEEQNSQFQSLEQVKRRPAHLMALLQHVALQFEPGPLVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 61786 - protein, 912 aa, Homo sapiens
MEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 61787 - protein, 948 aa, Homo sapiens
MASLSTWSSPAEPREMEDFARGAASPGPSRPGLVPVSIIGAEDEDFENELETNSEEQNSQFQSLEQVKRRPAHLMALLQHVALQFEPGPLVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKGVGGGILPPETPPVSAWGELCPPAWLHLRFPPRKAFCKKERNGGEDVRDHPHPHSCRSISHPEGLRRGSCGPRLGGAQLGLLAPHEPRPSLPPALCLGDSGLHSGGHHGDPGHLSIACGGHPSTPTPKCLRSVFIP

SEQ ID NO: 61788 - protein, 1340 aa, Homo sapiens
MRPPGFLSRAPSLNRAERGIWSCSMDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEAETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 61789 - protein, 1344 aa, Homo sapiens
MDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 61790 - protein, 610 aa, Homo sapiens
MRPPGFLSRAPSLNRAERGIWSCSMDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEAETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKVERGFLQLYSKIIFALC

SEQ ID NO: 61791 - protein, 1369 aa, Homo sapiens
MRPPGFLSRAPSLNRAERGIWSCSMDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEAETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 61792 - protein, 1368 aa, Homo sapiens
MRPPGFLSRAPSLNRAERGIWSCSMDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEAETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 61793 - protein, 982 aa, Homo sapiens
MLPSSSWGKRKLRGRLGWVRSDARGVMWARQEGLHHPHPHAVIRCPSSSSSSVSCSGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPWVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDIWVRSRPCARDAHRKEICSVAIISGGQGYRNFGSALGSSGRQAPCGETDSTLLIWQVPLML

SEQ ID NO: 61794 - protein, 1279 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKLSPDLTRLKERYARTKRDILALRVGGRDMQELKHKYDCKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKPANHRGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPWVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDIWVRSRPCARDAHRKEICSVAIISGGQGYRNFGSALGSSGRQAPCGETDSTLLIWQVPLML

SEQ ID NO: 61795 - protein, 1052 aa, Homo sapiens
MLPSSSWGKRKLRGRLGWVRSDARGVMWARQEGLHHPHPHAVIRCPSSSSSSVSCSGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPWVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDIWVRSRPCARDAHRKEICSVAIISGGQGYRNFGSALGSSGRQAPCGETDSTLLIWQVPLML

SEQ ID NO: 61796 - protein, 1240 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKPANHRGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPWVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDIWVRSRPCARDAHRKEICSVAIISGGQGYRNFGSALGSSGRQAPCGETDSTLLIWQVPLML

SEQ ID NO: 61797 - protein, 488 aa, Homo sapiens
MTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKPANHRGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKGTWSDM

SEQ ID NO: 61798 - protein, 1067 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKLSPDLTRLKERYARTKRDILALRVGGRDMQELKHKYDCKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPWVTVLEATTLQPQQSFEAHQDEAVSVTHMVKAGSGVWMAFSSGTSIRLFHTETLEHLQEINIATRTTFLLPDRSLIKCSPRA

SEQ ID NO: 61799 - protein, 1240 aa, Homo sapiens; identical to SEQ ID NO: 61796

SEQ ID NO: 61800 - protein, 1042 aa, Homo sapiens
MLPSSSWGKRKLRGRLGWVRSDARGVMWARQEGLHHPHPHAVIRCPSSSSSSVSCSGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPWVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMAFFLKAKNTKPHNCLASPVSLVWALAGLQGSHTPLLEGCVRVSVCECVGWCVNIYK

SEQ ID NO: 61801 - protein, 1525 aa, Homo sapiens
MSGTQSTITDRFPLKKPIRHGSILNRESPTDKKQKVERIASHDFDPTGLVQRCVIIQKDDNGFGLTVSGDNPVFVQSVKEDGAAMRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKAYHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 61802 - protein, 1544 aa, Homo sapiens
MSGTQSTITDRFPLKKPIRHGSILNRESPTDKKQKVERIASHDFDPTDSSSKKTKSSSEESRSEIYGLVQRCVIIQKDDNGFGLTVSGDNPVFVQSVKEDGAAMRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKAYHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 61803 - protein, 802 aa, Homo sapiens
MDCGPPATLQPHLTGPPGTAHHPVAVCQQESLSFAELPALKPPSPVCLDLFPVAPEELRAPGSRWSLGTPAPLQGLLWPLSPGGSDTEITSGGMRPSRAGSWPHCPGAQPPALEGPWSPRHTQPQRRASHGSEKKSAWRKMRVYQREEVPGCPEAHAVFLEPGQVVQEQALSTEEPRVELSGSTRVSLEGPERRRFSASELMTRLHSSLRLGRNSAARALISGSGTGAAREGKASGMEARSVEMSGDRVSRPAPGDSREGDWSEPRLDTQEEPPLGSRSTNERRQSRFLLNSVLYQEYSDVASARELRRQQREEEGPGDEAEGAEEGPGPPRANLSPSSSFRAQRSARGSTFSLWQDIPDVRGSGVLATLSLRDCKLQEAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLLLENPRFPGILARLEESPVCQRLPLTSFLILPFQRITRLKMLVENILKRTAQGSEDEDMATKAFNALKELVQECNASVQSMKRTEELIHLSKKIHFEGKIFPLISQARWLVRHGELVELAPLPAAPPAKLKLSSKAVYLHLFNDCLLLSRRKELGKFAVFVHAKMAELQVRDLSLKLQGIPGHVFLLQLLHGQHMKHQFLLRARTESEKQRWISALCPSSPQEDKEVISEGEDCPQVQCVRTYKALHPDELTLEKTDILSVRTWTSDGWLEGVRLADGEKGWVPQAYVEEISSLSARLRNLRENKRVTSATSKLGEAPV

SEQ ID NO: 61804 - protein, 524 aa, Homo sapiens
MDCGPPATLQPHLTGPPGTAHHPVAVCQQESLSFAELPALKPPSPVCLDLFPVAPEELRAPGSRWSLGTPAPLQGLLWPLSPGGSDTEITSGGMRPSRAGSWPHCPGAQPPALEGPWSPRHTQPQRRASHGSEKKSAWRKMRVYQREEVPGCPEAHAVFLEPGQVVQEQALSTEEPRVELSGSTRVSLEGPERRRFSASELMTRLHSSLRLGRNSAARALISGSGTGAAREGKASGMEARSVEMSGDRVSRPAPGDSREGDWSEPRLDTQEEPPLGSRSTNERRQSRFLLNSVLYQEYSDVASARELRRQQREEEGPGDEAEGAEEGPGPPRANLSPSSSFRAQRSARGSTFSLWQDIPDVRGSGVLATLSLRDCKLQEAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLLLENPRFPGILARLEESPVCQRLPLTSFLILQPPGGQGGHQ

SEQ ID NO: 61805 - protein, 502 aa, Homo sapiens
MDCGPPATLQPHLTGPPGTAHHPVAVCQQESLSFAELPALKPPSPVCLDLFPVAPEELRAPGSRWSLGTPAPLQGLLWPLSPGGSDTEITSGGMRPSRAGSWPHCPGAQPPALEGPWSPRHTQPQRRASHGSEKKSAWRKMRVYQREEVPGCPEAHAVFLEPGQVVQEQALSTEEPRVELSGSTRVSLEGPERRRFSASELMTRLHSSLRLGRNSAARALISGSGTGAAREGKASGMEARSVEMSGDRVSRPAPGDSREGDWSEPRLDTQEEPPLGSRSTNERRQSRFLLNSVLYQEYSDVASARELRRQQREEEGPGDEAEGAEEGPGPPRANLSPSSSFRAQRSARGSTFSLWQDIPDVRGSGVLATLSLRDCKLQEAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLLRENKRVTSATSKLGEAPV

SEQ ID NO: 61806 - protein, 167 aa, Homo sapiens
ERLAQFPAAGRGSPGPPGARLGVGLEKGRGREVWRPGVWGCEARASEVNWSCPFDPVCALPQAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLL

SEQ ID NO: 61807 - protein, 307 aa, Homo sapiens
  MOD_RES (1)..(1): Any amino acid
XRDRGQERLAQFPAAGRGSPGPPGARLGVGLEKGRGREVWRPGVWGCEARASEVNWSCPFDPVCALPQAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLLLENPRFPGILARLEESPVCQRLPLTSFLILPFQRITRLKMLVENILKRTAQGSEDEDMATKAFNALKELVQECNASVQSMKRTEELIHLSKKIHFEGKIFPLISQARWLVRHGELVELAPLPAAPPAKLKLSSK

SEQ ID NO: 61808 - protein, 526 aa, Homo sapiens
MVAKDYPFYLTVKRANCSLELPPASGPAKDAEEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 61809 - protein, 558 aa, Homo sapiens
MDSSTAMNQCSCRGMEENKERPKRQRQNNFPMFPSPKAWNFRGRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 61810 - protein, 532 aa, Homo sapiens
MIEVCHHNWLLWLCPSKFGIFMCCLASTTGQMELRRTREPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 61811 - protein, 690 aa, Homo sapiens
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 61812 - protein, 619 aa, Homo sapiens
MRPDGQQALDAVVRSFDCHSEAALRQRNDVIYCSLPRTAQGIVQREDQLEVLVSLREVWGRRRGRDGTCTGAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 61813 - protein, 670 aa, Homo sapiens
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKGRRTAAPPPRLPGPYPADIIPFSEPQSQAS

SEQ ID NO: 61814 - protein, 630 aa, Homo sapiens
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 61815 - protein, 192 aa, Homo sapiens
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAVGRPCYLTRQKHPALPSNRPQQQVLVLAEPRRKPSTFWHSISRLAPFRK

SEQ ID NO: 61816 - protein, 670 aa, Homo sapiens; identical to SEQ ID NO: 61813

SEQ ID NO: 61817 - protein, 1597 aa, Homo sapiens
MEAEEAQRGASPPISAIEEFSIIPEAPMRSSQVSALGLEAQEDEDPSYKWREEHRLSATQQSELRDVCDYAIETMPSFPKEGSADVEPNQESLVAEACDTPEHWEAVPQSLAGRQARTLAPPELWACPIQSEHLDMAPFSSDLGSEEEEVEFWPGLTSLTLGSGQAEEEEETSSDNSGQTRYYSPCEEHPAETNQNEGSESGTIRQGEELPPEELQESQGLLHPQEVQVLEEQGQQEAGFRGEGTLREDVCADGLLGEEQMIEQVNDEKGEQKQKQEQVQDVMLGRQGERMGLTGEPEGLNDGEWEQEDMERKAQGQGGPEQGEERKRELQVPEENRADSQDEKSQTFLGKSEEVTGKQEDHGIKEKGVPVSGQEAKEPESWDGGRLGAVGRARSREEENEHHGPSMPALIAPEDSPHCDLFPGASYLMTQIPGTQTESRAEELSPAALSPSLEPIRCSHQPISLLGSFLTEESPDKEIDQNSQQEESRLRKGTVSSQGTEVVFASASVTPPRTPDSAPPSPAEAYPITPASVSARPPVAFPRRETSCAARAPETASAPLSMDDPSPCGTSEMCPAALYGFPSTGTSPPRPPANSTGTVQHLRSDSFPGSHRTEQTPDLVGMLLSYSHSELPQRPPKPAIYSSVTPRRDRRSGRDYSTVSASPTALSTLKQDSQESISNLERPSSPPSIQPWVSPHNPAFATESPAYGSSPSFVSMEDVRIHEPLPPPPPQRRDTHPSVVETDGHARVVVPTLKQHSHPPPLALGSGLHAPHKGPLPQASDPAVARQHRPLPSTPDSSHHAQATPRWRYNKPLPPTPDLPQPHLPPISAPGSSRIYRPLPPLPIIDPPTEPPPLPPKSRGRSRSTRGGHMNSGGHAKTRPACQDWTVPLPASAGRTSWPPATARSTESFTSTSRSKSEVSPGMAFSNMTNFLCPSSPTTPWTPELQGPTSKDEAGVSEHPEAPAREPLRRTTPQQGASGPGRSPVGQARQPEKPSHLHLEKASSWPHRRDSGRPPGDSSGQAVAPSEGANKHKGWSRQGLRRPSILPEGSSDSRGPAVEKHPGPSDTVVFREKKPKEVMGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPREGSRFLVFDHAPFSSIRGEKCEMKLHGPHKNLFRLFLRQNTQGAQAEFLFRTETQSEKLRWISALAMPREELDLLECYNSPQVQCLRAYKPRENDELALEKADVVMVTQQSSDGWLEGVRLSDGERGWFPVQQVEFISNPEVRAQNLKEAHRVKTAKLQLVEQQA

SEQ ID NO: 61818 - protein, 398 aa, Homo sapiens
MASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPRESEKLRWISALAMPREELDLLECYNSPQVQCLRAYKPRENDELALEKADVVMVTQQSSDGWLEGVRLSDGERGWFPVQQVEFISNPEVRAQNLKEAHRVKTAKLQLVEQQA

SEQ ID NO: 61819 - protein, 519 aa, Homo sapiens
MGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPREGSRFLVFDHAPFSSIRGEKCEMKLHGPHKNLFRLFLRQNTQGAQAEFLFRTETQSEKLRWISALAMPREELDLLECYNSPQVQCLRAYKPRENDELALEKADVVMVTQQSSDGWLEGVRLSDGERGWFPVQQVEFISNPEVRAQNLKEAHRVKTAKLQLVEQQA

SEQ ID NO: 61820 - protein, 797 aa, Homo sapiens
  MOD_RES (1)..(1): Any amino acid
XVVVPTLKQHSHPPPLALGSGLHAPHKGPLPQASDPAVARQHRPLPSTPDSSHHAQATPRWRYNKPLPPTPDLPQPHLPPISAPGSSRIYRPLPPLPIIDPPTEPPPLPPKSRGRSRSTRGGHMNSGGHAKTRPACQDWTVPLPASAGRTSWPPATARSTESFTSTSRSKSEVSPGMAFSNMTNFLCPSSPTTPWTPELQGPTSKDEAGVSEHPEAPAREPLRRTTPQQGASGPGRSPVGQARQPEKPSHLHLEKASSWPHRRDSGRPPGDSSGQAVAPSEGANKHKGWSRQGLRRPSILPEGSSDSRGPAVEKHPGPSDTVVFREKKPKEVMGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPRESEKLRWISALAMPREELDLLECYNSPQVQCLRAYKPRENDELALEKADVVMVTQQSSDGWLEGVRLSDGERGWFPVQQVEFISNPEVRAQNLKEAHRVKTAKLQLVEQQA

SEQ ID NO: 61821 - protein, 985 aa, Homo sapiens
MSRIESLTRARIDRSRELASKTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 61822 - protein, 958 aa, Homo sapiens
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 61823 - protein, 986 aa, Homo sapiens
MSRIESLTRARIDRSRELASKTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 61824 - protein, 987 aa, Homo sapiens
MCCCCGCCPLLAHLEQGSLRERTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 61825 - protein, 958 aa, Homo sapiens; identical to SEQ ID NO: 61822

SEQ ID NO: 61826 - protein, 515 aa, Homo sapiens
MLSKSVPVSGINCLLDRSDTDGNVSQSSAIDLRKRCSQLEGHSGTRVGSSLRQTFSFLSGMTGKAKTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNLLLLFSLSPSFMEALGDNLASWS

SEQ ID NO: 61827 - protein, 443 aa, Homo sapiens
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNLLLLFSLSPSFMEALGDNLASWS

SEQ ID NO: 61828 - protein, 1388 aa, Homo sapiens
MSRPPPTGKMPGAPETAPGDGAGASRQRKLEALIRDPRSPINVESLLDGLNSLVLDLDFPALRKNKNIDNFLNRYEKIVKKIRGLQMKAEDYDVVKVIGRGAFGEVQLVRHKASQKVYAMKLLSKFEMIKRSDSAFFWEERDIMAFANSPWVVQLFYAFQDDRYLYMVMEYMPGGDLVNLMSNYDVPEKWAKFYTAEVVLALDAIHSMGLIHRDVKPDNMLLDKHGHLKLADFGTCMKMDETGMVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFFKNDQWHWDNIRETAAPVVPELSSDIDSSNFDDIEDDKGDVETFPIPKAFVGNQLPFIGFTYYRENLLLSDSPSCRETDSIQSRKNEESQEIQKKLYTLEEHLSNEMQAKEELEQKCKSVNTRLEKTAKELEEEITLRKSVESALRQLEREKALLQHKNAEYQRKADHEADKKRNLENDVNSLKDQLEDLKKRNQNSQISTEKVNQLQRQLDETNALLRTESDTAARLRKTQAESSKQIQQLESNNRDLQDKNCLLETAKLKLEKEFINLQSALESERRDRTHGSEIINDLQGRICGLEEDLKNGKILLAKVELEKRQLQERFTDLEKEKSNMEIDMTYQLKVIQQSLEQEEAEHKATKARLADKNKIYESIEEAKSEAMKEMEKKLLEERTLKQKVENLLLEAEKRCSLLDCDLKQSQQKINELLKQKDVLNEDVRNLTLKIEQETQKRCLTQNDLKMQTQQVNTLKMSEKQLKQENNHLMEMKMNLEKQNAELRKERQDADGQMKELQDQLEAEQYFSTLYKTQVRELKEECEEKTKLGKELQQKKQELQDERDSLAAQLEITLTKADSEQLARSIAEEQYSDLEKEKIMKELEIKEMMARHKQELTEKDATIASLEETNRTLTSDVANLANEKEELNNKLKDVQEQLSRLKDEEISAAAIKAQFEKQLLTERTLKTQAVNKLAEIMNRKEPVKRGNDTDVRRKEKENRKLHMELKSEREKLTQQMIKYQKELNEMQAQIAEESQIRIELQMTLDSKDSDIEQLRSQLQALHIGLDSSSIGSGPGDAEADDGFPESRLEGWLSLPVRNNTKKFGWVKKYVIVSSKKILFYDSEQDKEQSNPYMVLDIDKLFHVRPVTQTDVYRADAKEIPRIFQILYANEGESKKEQEFPVEPVGEKSNYICHKGHEFIPTLYHFPTNCEACMKPLWHMFKPPPALECRRCHIKCHKDHMDKKEEIIAPCKVYYDISTAKNLLLLANSTEEQQKWVSRLVKKIPKKPPAPDPFARSSPRTSMKIQQNQSIRRPSRQLAPNKPS

SEQ ID NO: 61829 - protein, 746 aa, Homo sapiens
MIYKVECGLEEDLKNGKILLAKVELEKRQLQERFTDLEKEKSNMEIDMTYQLKVIQQSLEQEEAEHKATKARLADKNKIYESIEEAKSEAMKEMEKKLLEERTLKQKVENLLLEAEKRCSLLDCDLKQSQQKINELLKQKDVLNEDVRNLTLKIEQETQKRCLTQNDLKMQTQQVNTLKMSEKQLKQENNHLMEMKMNLEKQNAELRKERQDADGQMKELQDQLEAEQYFSTLYKTQVRELKEECEEKTKLGKELQQKKQELQDERDSLAAQLEITLTKADSEQLARSIAEEQYSDLEKEKIMKELEIKEMMARHKQELTEKDATIASLEETNRTLTSDVANLANEKEELNNKLKDVQEQLSRLKDEEISAAAIKAQFEKQLLTERTLKTQAVNKLAEIMNRKEPVKRGNDTDVRRKEKENRKLHMELKSEREKLTQQMIKYQKELNEMQAQIAEESQIRIELQMTLDSKDSDIEQLRSQLQALHIGLDSSSIGSGPGDAEADDGFPESRLEGWLSLPVRNNTKKFGWVKKYVIVSSKKILFYDSEQDKEQSNPYMVLDIDKLFHVRPVTQTDVYRADAKEIPRIFQILYANEGESKKEQEFPVEPVGEKSNYICHKGHEFIPTLYHFPTNCEACMKPLWHMFKPPPALECRRCHIKCHKDHMDKKEEIIAPCKVYYDISTAKNLLLLANSTEEQQKWVSRLVKKIPKKPPAPDPFARSSPRTSMKIQQNQSIRRPSRQLAPNKPS

SEQ ID NO: 61830 - protein, 1145 aa, Homo sapiens
MVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFFKNDQWHWDNIRETAAPVVPELSSDIDSSNFDDIEDDKGDVETFPIPKAFVGNQLPFIGFTYYRENLLLSDSPSCRETDSIQSRKNEESQEIQKKLYTLEEHLSNEMQAKEELEQKCKSVNTRLEKTAKELEEEITLRKSVESALRQLEREKALLQHKNAEYQRKADHEADKKRNLENDVNSLKDQLEDLKKRNQNSQISTEKVNQLQRQLDETNALLRTESDTAARLRKTQAESSKQIQQLESNNRDLQDKNCLLETAKLKLEKEFINLQSALESERRDRTHGSEIINDLQGRICGLEEDLKNGKILLAKVELEKRQLQERFTDLEKEKSNMEIDMTYQLKVIQQSLEQEEAEHKATKARLADKNKIYESIEEAKSEAMKEMEKKLLEERTLKQKVENLLLEAEKRCSLLDCDLKQSQQKINELLKQKDVLNEDVRNLTLKIEQETQKRCLTQNDLKMQTQQVNTLKMSEKQLKQENNHLMEMKMNLEKQNAELRKERQDADGQMKELQDQLEAEQYFSTLYKTQVRELKEECEEKTKLGKELQQKKQELQDERDSLAAQLEITLTKADSEQLARSIAEEQYSDLEKEKIMKELEIKEMMARHKQELTEKDATIASLEETNRTLTSDVANLANEKEELNNKLKDVQEQLSRLKDEEISAAAIKAQFEKQLLTERTLKTQAVNKLAEIMNRKEPVKRGNDTDVRRKEKENRKLHMELKSEREKLTQQMIKYQKELNEMQAQIAEESQIRIELQMTLDSKDSDIEQLRSQLQALHIGLDSSSIGSGPGDAEADDGFPESRLEGWLSLPVRNNTKKFGWVKKYVIVSSKKILFYDSEQDKEQSNPYMVLDIDKLFHVRPVTQTDVYRADAKEIPRIFQILYANEGESKKEQEFPVEPVGEKSNYICHKGHEFIPTLYHFPTNCEACMKPLWHMFKPPPALECRRCHIKCHKDHMDKKEEIIAPCKVYYDISTAKNLLLLANSTEEQQKWVSRLVKKIPKKPPAPDPFARSSPRTSMKIQQNQSIRRPSRQLAPNKPS

SEQ ID NO: 61831 - protein, 855 aa, Homo sapiens
MSEARRDSTSSLQRKKPPWLKLDIPSAVPLTAEEPSFLQPLRRQAFLRSVSMPAETAHISSPHHELRRPVLQRQTSITQTIRRGTADWFGVSKDSDSTQKWQRKSIRHCSQRYGKLKPQVLRELDLPSQDNVSLTSTETPPPLYVGPCQLGMQKIIDPLARGRAFRVADDTAEGLSAPHTPVTPGAASLCSFSSSRSGFHRLPRRRKRESVAKMSFRAAAALMKGRSVRDGTFRRAQRRSFTPASFLEEDTTDFPDELDTSFFAREGILHEELSTYPDEVFESPSEAALKDWEKAPEQADLTGGALDRSELERSHLMLPLERGWRKQKEGAAAPQPKVRLRQEVVSTAGPRRGQRIAVPVRKLFAREKRPYGLGMVGRLTNRTYRKRIDSFVKRQIEDMDDHRPFFTYWLTFVHSLVTILAVCIYGIAPVGFSQHETVDSVLRNRGVYENVKYVQQENFWIGPSSEALIHLGAKFSPCMRQDPQVHSFIRSAREREKHSACCVRNDRSGCVQTSEEECSSTLAVWVKWPIHPSAPELAGHKRQFGSVCHQDPRVCDEPSSEDPHEWPEDITKWPICTKNSAGNHTNHPHMDCVITGRPCCIGTKGRCEITSREYCDFMRGYFHEEATLCSQVHCMDDVCGLLPFLNPEVPDQFYRLWLSLFLHAGILHCLVSICFQMTVLRDLEKLAGWHRIAIIYLLSGVTGNLASAIFLPYRAEVGPAGSQFGILACLFVELFQSWQILARPWRAFFKLLAVVLFLFTFGLLPWIDNFAHISGFISGLFLSFAFLPYISFGKFDLYRKRCQIIIFQVVFLGLLAGLVVLFYVYPVRCEWCEFLTCIPFTDKFCEKYELDAQLH

SEQ ID NO: 61832 - protein, 190 aa, Homo sapiens
MSEARRDSTSSLQRKKPPWLKLDIPSAVPLTAEEPSFLQPLRRQAFLRSVSMPAETAHISSPHHELRRPVLQRQTSITQTIRSSRQVRFGRVHTLPLLGPRAARRAFPQRQSLSWSLLRGTADWFGVSKDSDSTQKWQRKSIRHCSQRYGKLKPQVLRELDLPSQDNVSLTSTETPPPLYVGPCQLGMQK

SEQ ID NO: 61833 - protein, 232 aa, Homo sapiens
  MOD_RES (1)..(1): Any amino acid
XRPCCIGTKGRCEITSREYCDFMRGYFHEEATLCSQVHCMDDVCGLLPFLNPEMTVLRDLEKLAGWHRIAIIYLLSGVTGNLASAIFLPYRAEVGPAGSQFGILACLFVELFQSWQILARPWRAFFKLLAVVLFLFTFGLLPWIDNFAHISGFISGLFLSFAFLPYISFGKFDLYRKRCQIIIFQVVFLGLLAGLVVLFYVYPVRCEWCEFLTCIPFTDKFCEKYELDAQLH

SEQ ID NO: 61834 - protein, 163 aa, Homo sapiens
MSEARRDSTSSLQRKKPPWLKLDIPSAVPLTAEEPSFLQPLRRQAFLRSVSMPAETAHISSPHHELRRPVLQRQTSITQTIRRGTADWFGVSKDSDSTQKWQRKSIRHCSQRYGKLKPQVLRELDLPSQDNVSLTSTETPPPLYVGPCQLGMQKIIDPLARGR

SEQ ID NO: 61835 - protein, 579 aa, Homo sapiens
MSEARRDSTSSLQRKKPPWLKLDIPSAVPLTAEEPSFLQPLRRQAFLRSVSMPAETAHISSPHHELRRPVLQRQTSITQTIRRGTADWFGVSKDSDSTQKWQRKSIRHCSQRYGKLKPQVLRELDLPSQDNVSLTSTETPPPLYVGPCQLGMQKIIDPLARGRAFRVADDTAEGLSAPHTPVTPGAASLCSFSSSRSGFHRLPRRRKRESVAKMSFRAAAALMKGRSVRDGTFRRAQRRSFTPASFLEEDTTDFPDELDTSFFAREGILHEELSTYPDEVFESPSEAALKDWEKAPEQADLTGGALDRSELERSHLMLPLERGWRKQKEGAAAPQPKVRLRQEVVSTAGPRRGQRIAVPVRKLFAREKRPYGLGMVGRLTNRTYRKRIDSFVKRQIEDMDDHRPFFTYWLTFVHSLVTILAVCIYGIAPVGFSQHETVDSVLRNRGVYENVKYVQQENFWIGPSSVRTGLGAGPAGAGPGGARRGQEAPDCGRSSPSPAGGPHPPGRQVFALHAPGPAGAQLHSLGARAREALRLLRAQRQVGLRADLGGGVLGAFPRPGLPPSSARCSLFRPQIDSAE

SEQ ID NO: 61836 - protein, 856 aa, Homo sapiens
MASADKNGGSVSSVSSSRLQSRKPPNLSITIPPPEKETQAPGEQDSMLPEGFQNRRLKKSQPRTWAAHTTACPPSFLPKRKNPAYLKSVSLQEPRSRWQESSEKRPGFRRQASLSQSIRKGAAQWFGVSGDWEGQRQQWQRRSLHHCSMRYGRLKASCQRDLELPSQEAPSFQGTESPKPCKMPKIVDPLARGRAFRHPEEMDRPHAPHPPLTPGVLSLTSFTSVRSGYSHLPRRKRMSVAHMSLQAAAALLKGRSVLDATGQRCRVVKRSFAFPSFLEEDVVDGADTFDSSFFSKEEMSSMPDDVFESPPLSASYFRGIPHSASPVSPDGVQIPLKEYGRAPVPGPRRGKRIASKVKHFAFDRKKRHYGLGVVGNWLNRSYRRSISSTVQRQLESFDSHRPYFTYWLTFVHVIITLLVICTYGIAPVGFAQHVTTQLVLRNKGVYESVKYIQQENFWVGPSSIDLIHLGAKFSPCIRKDGQIEQLVLRERDLERDSGCCVQNDHSGCIQTQRKDCSETLATFVKWQDDTGPPMDKSDLGQKRTSGAVCHQDPRTCEEPASSGAHIWPDDITKWPICTEQARSNHTGFLHMDCEIKGRPCCIGTKGSCEITTREYCEFMHGYFHEEATLCSQVHCLDKVCGLLPFLNPEVPDQFYRLWLSLFLHAGVVHCLVSVVFQMTILRDLEKLAGWHRIAIIFILSGITGNLASAIFLPYRAEVGPAGSQFGLLACLFVELFQSWPLLERPWKAFLNLSAIVLFLFICGLLPWIDNIAHIFGFLSGLLLAFAFLPYITFGTSDKYRKRALILVSLLAFAGLFAALVLWLYIYPINWPWIEHLTCFPFTSRFCEKYELDQVLH

SEQ ID NO: 61837 - protein, 827 aa, Homo sapiens
MASADKNGGSVSSVSSSRLQSRKPPNLSITIPPPEKETQAPGEQDSMLPERKNPAYLKSVSLQEPRSRWQESSEKRPGFRRQASLSQSIRKGAAQWFGVSGDWEGQRQQWQRRSLHHCSMRYGRLKASCQRDLELPSQEAPSFQGTESPKPCKMPKIVDPLARGRAFRHPEEMDRPHAPHPPLTPGVLSLTSFTSVRSGYSHLPRRKRMSVAHMSLQAAAALLKGRSVLDATGQRCRVVKRSFAFPSFLEEDVVDGADTFDSSFFSKEEMSSMPDDVFESPPLSASYFRGIPHSASPVSPDGVQIPLKEYGRAPVPGPRRGKRIASKVKHFAFDRKKRHYGLGVVGNWLNRSYRRSISSTVQRQLESFDSHRPYFTYWLTFVHVIITLLVICTYGIAPVGFAQHVTTQLVLRNKGVYESVKYIQQENFWVGPSSIDLIHLGAKFSPCIRKDGQIEQLVLRERDLERDSGCCVQNDHSGCIQTQRKDCSETLATFVKWQDDTGPPMDKSDLGQKRTSGAVCHQDPRTCEEPASSGAHIWPDDITKWPICTEQARSNHTGFLHMDCEIKGRPCCIGTKGSCEITTREYCEFMHGYFHEEATLCSQVHCLDKVCGLLPFLNPEVPDQFYRLWLSLFLHAGVVHCLVSVVFQMTILRDLEKLAGWHRIAIIFILSGITGNLASAIFLPYRAEVGPAGSQFGLLACLFVELFQSWPLLERPWKAFLNLSAIVLFLFICGLLPWIDNIAHIFGFLSGLLLAFAFLPYITFGTSDKYRKRALILVSLLAFAGLFAALVLWLYIYPINWPWIEHLTCFPFTSRFCEKYELDQVLH

SEQ ID NO: 61838 - protein, 716 aa, Homo sapiens
PGSSRSRHPLLLLIWSLGSSQGPHRQIRPPPPCRHAGTHVPSPLPHTQVHRRRQAYAHLSLVCFRRGAAQWFGVSGDWEGQRQQWQRRSLHHCSMRYGRLKASCQRDLELPSQEAPSFQGTESPKPCKMPKIVDPLARGRAFRHPEEMDRPHAPHPPLTPGVLSLTSFTSVRSGYSHLPRRKRMSVAHMSLQAAAALLKGRSVLDATGQRCRVVKRSFAFPSFLEEDVVDGADTFDSSFFSKEEMSSMPDDVFESPPLSASYFRGIPHSASPVSPDGVQIPLKEYGRAPVPGPRRGKRIASKVKHFAFDRKKRHYGLGVVGNWLNRSYRRSISSTVQRQLESFDSHRPYFTYWLTFVHVIITLLVICTYGIAPVGFAQHVTTQLVLRNKGVYESVKYIQQENFWVGPSSIDLIHLGAKFSPCIRKDGQIEQLVLRERDLERDSGCCVQNDHSGCIQTQRKDCSETLATFVKWQDDTGPPMDKSDLGQKRTSGAVCHQDPRTCEEPASSGAHIWPDDITKWPICTEQARSNHTGFLHMDCEIKGRPCCIGTKGSCEITTREYCEFMHGYFHEEATLCSQVHCLDKVCGLLPFLNPEVPDQFYRLWLSLFLHAGVVHCLVSVVFQMTILRDLEKLAGWHRIAIIFILSGITGNLASAIFLPYRAEVRMWRMGPLPHIGGQPCCSYSTHLGSARGTRCPSCTGLHSGGTANLGAYWLVS

SEQ ID NO: 61839 - protein, 212 aa, Homo sapiens
MAQTDKPTCIPPELPKMLKEFAKAAIRVQPQDLIQWAADYFEALSRGETPPVRERSERVALCNRAELTPELLKILHSQVAGRLIIRAEELAQMWKVVNLPTDLFNSVMNVGRFTEEIEWLKFLALACSALGVTITKTLKIVCEVLSCDHNGGSPRIPFSTFQFLYTYIAKVDGEISASHVSRMLNYMEQEVIGPDGIITVNDFTQNPRVQLE

SEQ ID NO: 61840 - protein, 212 aa, Homo sapiens; identical to SEQ ID NO: 61839

SEQ ID NO: 61841 - protein, 116 aa, Homo sapiens
MAQTDKPTCIPPELPKMLKEFAKAAIRVQPQDLIQWAADYFEALSRGETPPVRERSERVALCNRAELTPELLKILHSQVAGRLIIRAEELAQMWKVVNLPTDLFNSVMNVGRFTEE

SEQ ID NO: 61842 - protein, 130 aa, Homo sapiens
MAQTDKPTCIPPELPKMLKEFAKAAIRVQPQDLIQWAADYFEALSRGETPPVRERSERVALCNRAELTPELLKILHSQVAGRLIIRAEELAQMWKVVNLPTDLFNSVMNVGRFTEEIEWLKFLALACSAL

SEQ ID NO: 61843 - protein, 103 aa, Homo sapiens
MAQTDKPTCIPPELPKMLKEFAKAAIRVQPQDLIQWAADYFEALSRGETPPVRERSERVALCNRAELTPELLKILHSQVAGRLIIRAEELAQMWKVVNLPTDL

SEQ ID NO: 61844 - protein, 77 aa, Homo sapiens
MAQTDKPTCIPPELPKMLKEFAKAAIRVQPQDLIQWAADYFEALSRGETPPVRERSERVALCNRAELTPELLKILHS

SEQ ID NO: 61845 - protein, 230 aa, Homo sapiens
MPLPDTMFCAQQIHIPPELPDILKQFTKAAIRTQPADVLRWSAGYFSALSRGDPLPVKDRMEMPTATQKTDTGLTQGLLKVLHKQCHHKRYVELTDLEQKWKNLCLPKEKFKALLQLDPCENKIKWINFLALGCSMLGGSLNTALKHLCEILTDDPEGGPARIPFKTFSYVYRYLARLDSDVSPLETESYLASLKENIDARKNGMIGLSDFFFPKRKLLESIENSEDVGH

SEQ ID NO: 61846 - protein, 230 aa, Homo sapiens; identical to SEQ ID NO: 61845

SEQ ID NO: 61847 - protein, 696 aa, Homo sapiens
MDADMDYERPNVETIKCVVVGDNAVGKTRLICARACNTTLTQYQLLATHVPTVWAIDQYRVCQEVLERSRDVVDEVSVSLRLWDTFGDHHKDRRFAYGRSDVVVLCFSIANPNSLNHVKSMWYPEIKHFCPRTPVILVGCQLDLRYADLEAVNRARRPLARPIKRGDILPPEKGREVAKELGLPYYETSVFDQFGIKDVFDNAIRAALISRRHLQFWKSHLKKVQKPLLQAPFLPPKAPPPVIKIPECPSMGTNEAACLLDNPLCADVLFILQDQEHIFAHRIYLATSSSKFYDLFLMECEESPNGSEGACEKEKQSRDFQGRILSVDPEEEREEGPPRIPQADQWKSSNKSLVEALGLEAEGAVPETQTLTGWSKGFIGMHREMQVNPISKRMGPMTVVRMDASVQPGPFRTLLQFLYTGQLDEKEKDLVGLAQIAEVLEMFDLRMMVENIMNKEAFMNQEITKAFHVRKANRIKECLSKGTFSDVTFKLDDGAISAHKPLLICSCEWMAAMFGGSFVESANSEVYLPNINKISMQAVLDYLYTKQLSPNLDLDPLELIALANRFCLPHLVALAEQHAVQELTKAATSGVGIDGEVLSYLELAQFHNAHQLAAWCLHHICTNYNSVCSKFRKEIKSKSADNQEYFERHRWPPVWYLKEEDHYQRVKREREKEDIALNKHRSRRKWCFWNSSPAVA

SEQ ID NO: 61848 - protein, 696 aa, Homo sapiens; identical to SEQ ID NO: 61847

SEQ ID NO: 61849 - protein, 99 aa, Homo sapiens
MDADMDYERPNVETIKCVVVGDNAVGKTRLICARACNTTLTQYQLLATHVPTVWAIDQYRVCQEVLERSRDVVDEVSVSLRLWDTFGDHHKDRRFAYGR

SEQ ID NO: 61850 - protein, 727 aa, Homo sapiens
MDSDMDYERPNVETIKCVVVGDNAVGKTRLICARACNATLTQYQLLATHVPTVWAIDQYRVCQEVLERSRDVVDDVSVSLRLWDTFGDHHKDRRFAYGRSDVVVLCFSIANPNSLHHVKTMWYPEIKHFCPRAPVILVGCQLDLRYADLEAVNRARRPLARPIKPNEILPPEKGREVAKELGIPYYETSVVAQFGIKDVFDNAIRAALISRRHLQFWKSHLRNVQRPLLQAPFLPPKPPPPIIVVPDPPSSSEECPAHLLEDPLCADVILVLQERVRIFAHKIYLSTSSSKFYDLFLMDLSEGELGGPSEPGGTHPEDHQGHSDQHHHHHHHHHGRDFLLRAASFDVCESVDEAGGSGPAGLRASTSDGILRGNGTGYLPGRGRVLSSWSRAFVSIQEEMAEDPLTYKSRLMVVVKMDSSIQPGPFRAVLKYLYTGELDENERDLMHIAHIAELLEVFDLRMMVANILNNEAFMNQEITKAFHVRRTNRVKECLAKGTFSDVTFILDDGTISAHKPLLISSCDWMAAMFGGPFVESSTREVVFPYTSKSCMRAVLEYLYTGMFTSSPDLDDMKLIILANRLCLPHLVALTEQYTVTGLMEATQMMVDIDGDVLVFLELAQFHCAYQLADWCLHHICTNYNNVCRKFPRDMKAMSPENQEYFEKHRWPPVWYLKEEDHYQRARKEREKEDYLHLKRQPKRRWLFWNSPSSPSSSAASSSSPSSSSAVV

SEQ ID NO: 61851 - protein, 749 aa, Homo sapiens
MQAWRKGPDGPQKTSSDSMSRLMDSDMDYERPNVETIKCVVVGDNAVGKTRLICARACNATLTQYQLLATHVPTVWAIDQYRVCQEVLERSRDVVDDVSVSLRLWDTFGDHHKDRRFAYGRSDVVVLCFSIANPNSLHHVKTMWYPEIKHFCPRAPVILVGCQLDLRYADLEAVNRARRPLARPIKPNEILPPEKGREVAKELGIPYYETSVVAQFGIKDVFDNAIRAALISRRHLQFWKSHLRNVQRPLLQAPFLPPKPPPPIIVVPDPPSSSEECPAHLLEDPLCADVILVLQERVRIFAHKIYLSTSSSKFYDLFLMDLSEGELGGPSEPGGTHPEDHQGHSDQHHHHHHHHHGRDFLLRAASFDVCESVDEAGGSGPAGLRASTSDGILRGNGTGYLPGRGRVLSSWSRAFVSIQEEMAEDPLTYKSRLMVVVKMDSSIQPGPFRAVLKYLYTGELDENERDLMHIAHIAELLEVFDLRMMVANILNNEAFMNQEITKAFHVRRTNRVKECLAKGTFSDVTFILDDGTISAHKPLLISSCDWMAAMFGGPFVESSTREVVFPYTSKSCMRAVLEYLYTGMFTSSPDLDDMKLIILANRLCLPHLVALTEQYTVTGLMEATQMMVDIDGDVLVFLELAQFHCAYQLADWCLHHICTNYNNVCRKFPRDMKAMSPENQEYFEKHRWPPVWYLKEEDHYQRARKEREKEDYLHLKRQPKRRWLFWNSPSSPSSSAASSSSPSSSSAVV

SEQ ID NO: 61852 - protein, 734 aa, Homo sapiens
MKARSRLMDSDMDYERPNVETIKCVVVGDNAVGKTRLICARACNATLTQYQLLATHVPTVWAIDQYRVCQEVLERSRDVVDDVSVSLRLWDTFGDHHKDRRFAYGRSDVVVLCFSIANPNSLHHVKTMWYPEIKHFCPRAPVILVGCQLDLRYADLEAVNRARRPLARPIKPNEILPPEKGREVAKELGIPYYETSVVAQFGIKDVFDNAIRAALISRRHLQFWKSHLRNVQRPLLQAPFLPPKPPPPIIVVPDPPSSSEECPAHLLEDPLCADVILVLQERVRIFAHKIYLSTSSSKFYDLFLMDLSEGELGGPSEPGGTHPEDHQGHSDQHHHHHHHHHGRDFLLRAASFDVCESVDEAGGSGPAGLRASTSDGILRGNGTGYLPGRGRVLSSWSRAFVSIQEEMAEDPLTYKSRLMVVVKMDSSIQPGPFRAVLKYLYTGELDENERDLMHIAHIAELLEVFDLRMMVANILNNEAFMNQEITKAFHVRRTNRVKECLAKGTFSDVTFILDDGTISAHKPLLISSCDWMAAMFGGPFVESSTREVVFPYTSKSCMRAVLEYLYTGMFTSSPDLDDMKLIILANRLCLPHLVALTEQYTVTGLMEATQMMVDIDGDVLVFLELAQFHCAYQLADWCLHHICTNYNNVCRKFPRDMKAMSPENQEYFEKHRWPPVWYLKEEDHYQRARKEREKEDYLHLKRQPKRRWLFWNSPSSPSSSAASSSSPSSSSAVV

SEQ ID NO: 61853 - protein, 611 aa, Homo sapiens
MSIHIVALGNEGDTFHQDNRPSGLIRTYLGRSPLVSGDESSLLLNAASTVARPVFTEYQASAFGNVKLVVHDCPVWDIFDSDWYTSRNLIGGADIIVIKYNVNDKFSFHEVKDNYIPVIKRALNSVPVIIAAVGTRQNEELPCTCPLCTSDRGSCVSTTEGIQLAKELGATYLELHSLDDFYIGKYFGGVLEYFMIQALNQKTSEKMKKRKMSNSFHGIRPPQLEQPEKMPVLKAEASHYNSDLNNLLFCCQCVDVVFYNPNLKKVVEAHKIVLCAVSHVFMLLFNVKSPTDIQDSSIIRTTQDLFAINRDTAFPGASHESSGNPPLRVIVKDALFCSCLSDILRFIYSGAFQWEELEEDIRKKLKDSGDVSNVIEKVKCILKTPGKINCLRNCKTYQARKPLWFYNTSLKFFLNKPMLADVVFEIQGTTVPAHRAILVARCEVMAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVM

SEQ ID NO: 61854 - protein, 117 aa, Homo sapiens
  MOD_RES (1)..(1): Any amino acid
XEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVIKRH

SEQ ID NO: 61855 - protein, 563 aa, Homo sapiens
MFSRNHRSRVTVARGSALEMEFKRGRFRLSLFSDLPEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASVAPAPDWTHPLPWGRPRTFSLDAVPPDHSPRARSVAPLPPQRSPRTRGLCSKGQPRTWLQSPV

SEQ ID NO: 61856 - protein, 550 aa, Homo sapiens
MQDRLHILEDLNMLYIRQMALSLEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASVAPAPDWTHPLPWGRPRTFSLDAVPPDHSPRARSVAPLPPQRSPRTRGLCSKGQPRTWLQSPV

SEQ ID NO: 61857 - protein, 513 aa, Homo sapiens
MREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASVAPAPDWTHPLPWGRPRTFSLDAVPPDHSPRARSVAPLPPQRSPRTRGLCSKGQPRTWLQSPV

SEQ ID NO: 61858 - protein, 155 aa, Homo sapiens
MRHLPYFCRGQVVRGFGRGSKQLGIPTANFPEQVVDNLPADISTGIYYGWASVGSGDVHKMVVSIGWNPYYKNTKKSMETHIMHTFKEDFYGEILNVAIVGYLRPEKNFDSLESLISAIQGDIEEAKKRLELPEHLKIKEDNFFQVSKSKIMNGH

SEQ ID NO: 61859 - protein, 322 aa, Homo sapiens [sequence omitted]

SEQ ID NO: 61860 - protein, 286 aa, Homo sapiens
MAASGEPQRQWQEEVAAVVVVGSCMTDLVSLTSRLPKTGETIHGHKFFIGFGGKGANQCVQAARLGAMTSMVCKVGKDSFGNDYIENLKQNDISTEFTYQTKDAATGTASIIVNNEGQNIIVIVAGANLLLNTEDLRAAANVISRAKVMVCQLEITPATSLEALTMARRSGVKTLFNPAPAIADLDPQFYTLSDVFCCNESEAEILTGLTVGSAADAGEAALVLLKRGCQVVIITLGAEGCVVLSQTEPEPKHIPTEKVKAVDTTCRPGSRPKSEAASVKKQKHYK

SEQ ID NO: 61861 - protein, 286 aa, Homo sapiens
MSWLLFLAHRVALAALPCRRGSRGFGMFYAVRRGRKTGVFLTWNECRAQVDRFPAARFKKFATEDEAWAFVRKSASPEVSEGHENQHGQESEAKASKRLREPLDGDGHESAEPYAKHMKPSVEPAPPVSRDTFSYMGDFVVVYTDGCCSSNGRRRPRAGIGVYWGPGHPLNVGIRLPGRQTNQRAEIHAACKAIEQAKTQNINKLVLYTDSMFTINGITNWVQGWKKNGWKTSAGKEVINKEDFVALERLTQGMDIQWMHVPGHSGFIGNEEADRLAREGAKQSED

SEQ ID NO: 61862 - protein, 299 aa, Homo sapiens
MDLSELERDNTGRCRLSSPVPAVCRKEPCVLGVDEAGRGPVLGPMVYAICYCPLPRLADLEALKVADSKTLLESERERLFAKMEDTDFVGWALDVLSPNLISTSMLGRVKYNLNSLSHDTATGLIQYALDQGVNVTQVFVDTVGMPETYQARLQQSFPGIEVTVKAKADALYPVVSAASICAKVARDQAVKKWQFVEKLQDLDTDYGSGYPNDPKTKAWLKEHVEPVFGFPQFVRFSWRTAQTILEKEAEDVIWEDSASENQEGLRKITSYFLNEGSQARPRSSHRYFLERGLESATSL

SEQ ID NO: 61863 - protein, 312 aa, Homo sapiens
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKKIKLSDEPVEAKEDYTKFNTKDLKTEKKNSKMTAAQKALAKVDKSGMKSIDTFFGVKNKKKIGKV

SEQ ID NO: 61864 - protein, 257 aa, Homo sapiens
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKMAAQRQKRGK

SEQ ID NO: 61865 - protein, 331 aa, Homo sapiens
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKKIKLSDEPVEAKEDYTKFNTKDLKTEKKNSKMTAAQKALAKVDKSGMKSIDTFFGVKKKLERFETLKIKSSKNICFLHVSVCPS

SEQ ID NO: 61866 - protein, 164 aa, Homo sapiens
MESGDEAAIERHRVHLRSATLRDAVPATLHLLPCEVAVDGPAPVGRFFTPAIRQGPEGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAIHAQVPED

SEQ ID NO: 61867 - protein, 741 aa, Homo sapiens
MESRDHNNPQEGPTSSSGRRAAVEDNHLLIKAVQNEDVDLVQQLLEGGANVNFQEEEGGWTPLHNAVQMSREDIVELLLRHGADPVLRKKNGATPFILAAIAGSVKLLKLFLSKGADVNECDFYGFTAFMEAAVYGKVKALKFLYKRGANVNLRRKTKEDQERLRKGGATALMDAAEKGHVEVLKILLDEMGADVNACDNMGRNALIHALLSSDDSDVEAITHLLLDHGADVNVRGERGKTPLILAVEKKHLGLVQRLLEQEHIEINDTDSDGKTALLLAVELKLKKIAELLCKRGASTDCGDLVMTARRNYDHSLVKVLLSHGAKEDFHPPAEDWKPQSSHWGAALKDLHRIYRPMIGKLKFFIDEKYKIADTSEGGIYLGFYEKQEVAVKTFCEGSPRAQREVSCLQSSRENSHLVTFYGSESHRGHLFVCVTLCEQTLEACLDVHRGEDVENEEDEFARNVLSSIFKAVQELHLSCGYTHQDLQPQNILIDSKKAAHLADFDKSIKWAGDPQEVKRDLEDLGRLVLYVVKKGSISFEDLKAQSNEEVVQLSPDEETKDLIHRLFHPGEHVRDCLSDLLGHPFFWTWESRYRTLRNVGNESDIKTRKSESEILRLLQPGPSEHSKSFDKWTTKINECVMKKMNKFYEKRGNFYQNTVGDLLKFIRNLGEHIDEEKHKKMKLKIGDPSLYFQKTFPDLVIYVYTKLQNTEYRKHFPQTHSPNKPQCDGAGGASGLASPGC

SEQ ID NO: 61868 - protein, 741 aa, Homo sapiens; identical to SEQ ID NO: 61867

SEQ ID NO: 61869 - protein, 652 aa, Homo sapiens
MESRDHNNPQEGPTSSSGRRAAVEDNHLLIKAVQNEDVDLVQQLLEGGANVNFQEEEGGWTPLHNAVQMSREDIVELLLRHGADPVLRKKNGATPFILAAIAGSVKLLKLFLSKGADVNECDFYGFTAFMEAAVYGKVKALKFLYKRGANVNLRRKTKEDQERLRKGGATALMDAAEKGHVEVLKILLDEMGADVNACDNMGRNALIHALLSSDDSDVEAITHLLLDHGADVNVRGERGKTPLILAVEKKHLGLVQRLLEQEHIEINDTDSDGKTALLLAVELKLKKIAELLCKRGASTDCGDLVMTARRNYDHSLVKVLLSHGAKEDFHPPAEDWKPQSSHWGAALKDLHRIYRPMIGKLKFFIDEKYKIADTSEGGIYLGFYEKQEVAVKTFCEGSPRAQREVSCLQSSRENSHLVTFYGSESHRGHLFVCVTLCEQTLEACLDVHRGEDVENEEDEFARNVLSSIFKAVQELHLSCGYTHQDLQPQNILIDSKKAAHLADFDKSIKWAGDPQEVKRDLEDLGRLVLYVVKKGSISFEDLKAQSNEEVVQLSPDEETKDLIHRLFHPGEHVRDCLSDLLGHPFFWTWESRYRTLRNVGNESDIKTRKSESEILRLLQPGPSEHSKSFDKWTTKMSKLRHRQIIFPTTQNQ

SEQ ID NO: 61870 - protein, 154 aa, Homo sapiens
MIGKLKFFIDEKYKIADTSEGGIYLGFYEKQEVAVKTFCEGSPRAQREVSCLQSSRENSHLVTFYGSESHRGHLFVCVTLCEQTLEACLDVHRGEDVENEEDEFARNVLSSIFKAVQELHLSCGYTHQDLQPQNILIGPWTAGPLCGKEGKHLI

SEQ ID NO: 61871 - protein, 154 aa, Homo sapiens
MAGPVKDREAFQRLNFLYQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 61872 - protein, 162 aa, Homo sapiens
MAGPVKDREAFQRLNFLYQAAHCVLAQDPENQALARFYCYTERTIAKRLVLRRPLSSSAPRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTKGSSNQ

SEQ ID NO: 61873 - protein, 177 aa, Homo sapiens
MAGPVKDREAFQRLNFLYQVSLRQGPHGDGARRPRVTAPLPQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 61874 - protein, 162 aa, Homo sapiens
MAGPVKDREAFQRLNFLYQAAHCVLAQDPENQALARFYCYTERTIAKRLVLRRPLSSSAPRDPSVKRTLCRGCSSLLVPGLTCTHRQRRCRGQRWTVQTCLTCQRSQRFLNDPGHLLWGDRPEAQLGSQADSKPLQPLPNTAHSISDRLPEEKMQTQGSSNQ

SEQ ID NO: 61875 - protein, 177 aa, Homo sapiens
MAGPVKDREAFQRLNFLYQVSLRQGPHGDGARRPRVTAPLPQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTKGSSNQ

SEQ ID NO: 61876 - protein, 154 aa, Homo sapiens [sequence omitted]

SEQ ID NO: 61877 - protein, 144 aa, Homo sapiens
MAGPVKDREAFQRLNFLYQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQAGERFQTTTTLAKHSPLHFRPPS

SEQ ID NO: 61878 - protein, 154 aa, Homo sapiens [sequence omitted]

SEQ ID NO: 61879 - protein, 154 aa, Homo sapiens
MAGPVKDREAFQRLNFLYQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTKGSSNQ

SEQ ID NO: 61880 - protein, 177 aa, Homo sapiens
MAGPVKDREAFQRLNFLYQVSLRQGPHGDGARRPRVTAPLPQAAHCVLAQDPENQALARFYCYTERTIAKRLVLRRDPSVKRTLCRGCSSLLVPGLTCTHRQRRCRGQRWTVQTCLTCQRSQRFLNDPGHLLWGDRPEAQLGSQADSKPLQPLPNTAHSISDRLPEEKMQTQGSSNQ

SEQ ID NO: 61881 - protein, 144 aa, Homo sapiens
MAGPVKDREAFQRLNFLYQAAHCVLAQDPENQALARFYCYTERTIAKRLVLRRDPSVKRTLCRGCSSLLVPGLTCTHRQRRCRGQRWTVQTCLTCQRSQRFLNDPGHLLWGDRPEAQLGSQAGERFQTTTTLAKHSPLHFRPPS

SEQ ID NO: 61882 - protein, 154 aa, Homo sapiens; identical to SEQ ID NO: 61871

SEQ ID NO: 61883 - protein, 162 aa, Homo sapiens
MAGPVKDREAFQRLNFLYQAAHCVLAQDPENQALARFYCYTERTIAKRLVLRRPLSSSAPRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 61884 - protein, 144 aa, Homo sapiens; identical to SEQ ID NO: 61881

SEQ ID NO: 61885 - protein, 177 aa, Homo sapiens; identical to SEQ ID NO: 61873

SEQ ID NO: 61886 - protein, 162 aa, Homo sapiens; identical to SEQ ID NO: 61874

SEQ ID NO: 61887 - protein, 177 aa, Homo sapiens; identical to SEQ ID NO: 61873

SEQ ID NO: 61888 - protein, 162 aa, Homo sapiens; identical to SEQ ID NO: 61883

SEQ ID NO: 61889 - protein, 154 aa, Homo sapiens [sequence omitted]

SEQ ID NO: 61890 - protein, 144 aa, Homo sapiens; identical to SEQ ID NO: 61877

SEQ ID NO: 61891 - protein, 144 aa, Homo sapiens; identical to SEQ ID NO: 61877

SEQ ID NO: 61892 - protein, 144 aa, Homo sapiens; identical to SEQ ID NO: 61877

SEQ ID NO: 61893 - protein, 177 aa, Homo sapiens; identical to SEQ ID NO: 61880

SEQ ID NO: 61894 - protein, 144 aa, Homo sapiens; identical to SEQ ID NO: 61881

SEQ ID NO: 61895 - protein, 154 aa, Homo sapiens; identical to SEQ ID NO: 61871

SEQ ID NO: 61896 - protein, 177 aa, Homo sapiens; identical to SEQ ID NO: 61880

SEQ ID NO: 61897 - protein, 162 aa, Homo sapiens; identical to SEQ ID NO: 61883

SEQ ID NO: 61898 - protein, 162 aa, Homo sapiens; identical to SEQ ID NO: 61874

SEQ ID NO: 61899 - protein, 254 aa, Homo sapiens
MAVFADLDLRAGSDLKALRGLVETAAHRELPRLRAWPTSCHPDHRATLRIGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKNVIISSAAERPLEIRGPYDVANLGLLFGLSESDAKAAVSTNCRAALLHG

SEQ ID NO: 61900 - protein, 268 aa, Homo sapiens
MAVFADLDLRAGSDLKALRGLVETAAHLGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKNVIISSAAERPLEIRGPYDVANLGLLFGLSESDAKAAVSTNCRAALLHGETRKTAFGIISTVKKPRPSEGDEDCLPASKKAKCEG

SEQ ID NO: 61901 - protein, 255 aa, Homo sapiens
MAVFADLDLRAGSDLKALRGLVETAAHLGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKPLEIRGPYDVANLGLLFGLSESDAKAAVSTNCRAALLHGETRKTAFGIISTVKKPRPSEGDEDCLPASKKAK

SEQ ID NO: 61902 - protein, 322 aa, Homo sapiens
MAVFADLDLRAGSDLKALRGLVETAAHLGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKNVIISSAAERPLEIRGPYDVANLGLLFGLSESDAKAAVSTNCRAALLHGETRKTAFGIISTVKKPRPSEGDEDCLPASKKAKWSHSVTQAGVQWHNLGSLQPLPLGLKPSSHLSLPRTRIQQRQLLISHQRDHTPKNRL

SEQ ID NO: 61903 - protein, 212 aa, Homo sapiens
EIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKPLEIRGPYDVANLGLLFGLSESDAKAAVSTNCRAALLHGETRKTAFGIISTVKKPRPSEGDEDCLPASKKAKCEG

SEQ ID NO: 61904 - protein, 283 aa, Homo sapiens
MAAAPQAPGRGSLRKTRPLVVKTSLNNPYIIRWSALESEDMHFILQTLEDRLKAIGLQKIEDKKKKNKTPFLKKESREKCSIAVDISENLKEKKTDAKQQVSGWTPAHVRKQLAIGVNEVTRALERRELLLVLVCKSVKPAMITSHLIQLSLSRSVPACQVPRLSERIAPVIGLKCVLALAFKKNTTDFVDEVRAIIPRVPSLSVPWLQDRIEDSGENLETEPLESQDRELLDTSFEDLSKPKRKLADGRQASVTLQPLKIKKLIPNPNKIRKPPKSKKATPK

SEQ ID NO: 61905 - protein, 167 aa, Homo sapiens
MAAAPQAPGRGSLRKTRPLVVKTSLNNPYIIRWSALESEDMHFILQTLEDRLKAIGLQKIEDKKKKNKTPFLKKESREKCSIAVDISENLKEKKTDAKQQVSGWTPAHVRKQLAIGVNEVTRALERRELLLVLVLTLLPRLECSGVIPAHCNPASWVQAILLPQPPE

SEQ ID NO: 61906 - protein, 283 aa, Homo sapiens; identical to SEQ ID NO: 61904

SEQ ID NO: 61907 - protein, 283 aa, Homo sapiens; identical to SEQ ID NO: 61904

SEQ ID NO: 61908 - protein, 169 aa, Homo sapiens
MAAAPQAPGRGSLRKTRPLVVKTSLNNPYIIRWSALESEDMHFILQTLEDRLKAIGLQKIEDKKKKNKTPFLKKESREKCSIAVDISENLKEKKTDAKQQVSGWTPAHVRKQLAIGVNEVTRALERRELLLVLVCKSVKPAMITSHLIQLSLSRSVPACQVPRLSERIA

SEQ ID NO: 61909 - protein, 363 aa, Homo sapiens
MATLRRLREAPRHLLVCEKSNFGNHKSRHRHLVQTHYYNYRVSFLIPECGILSEELKNLVMNTGPYYFVKNLPLHELITPEFISTFIKKGSCYALTYNTHIDEDNTVALLPNGKLILSLDKDTYEETGLQGHPSQFSGRKIMKFIVSIDLMELSLNLDSKKYERISWSFKEKKPLKFDFLLAWHKTGSEESTMMSYFSKYQIQEHQPKVALSTLRDLQCPVLQSSELEGTPEVSCRALELFDWLGAVFSNVDLNNEPNNFISTYCCPEPSTVVAKAYLCTITGFILPEKICLLLEHLCHYFDEPKLAPWVTLSVQGFADSPVSWEKNEHGFRKGGEHLYNFVIFNNQDYWLQMAVGANDHCPP

SEQ ID NO: 61910 - protein, 303 aa, Homo sapiens
MNTGPYYFVKNLPLHELITPEFISTFIKKGSCYALTYNTHIDEDNTVALLPNGKLILSLDKDTYEETGLQGHPSQFSGRKIMKFIVSIDLMELSLNLDSKKYERISWSFKEKKPLKFDFLLAWHKTGSEESTMMSYFSKYQIQEHQPKVALSTLRDLQCPVLQSSELEGTPEVSCRALELFDWLGAVFSNVDLNNEPNNFISTYCCPEPSTVVAKAYLCTITGFILPEKICLLLEHLCHYFDEPKLAPWVTLSVQGFADSPVSWEKNEHGFRKGGEHLYNFVIFNNQDYWLQMAVGANDHCPP

SEQ ID NO: 61911 - protein, 238 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKKNWMEITDSSLPSPSMGPAPPRWMRSTPRRSTLAEAWNSTGSWTSTGGCALPPAALPSGDLCCRPSLTAGSRGVGVDLTALQQLLHVHYSATGIIPEECSEPTKPFQIILHHDHTEWVQSIGMPIWTISSSESAIGKTRTQPACAVLSHDS

SEQ ID NO: 61912 - protein, 207 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKKNWMEITDSSLPSPSTDLLPEMRAYWPDVIHSFPNRSRFCGTCAAQVDALNSQKKYFGRSLELYRELDLNRWVRPSPGCTSQWGSLLSPKPDSWIQGSGCRPHCPPAASACALFGYWDHS

SEQ ID NO: 61913 - protein, 306 aa, Homo sapiens
MRPAALRGALLGCLCLALLCLGGADKRLRDNHEWKKLIMVQHWPETVCEKIQNDCRDPPDYWTIHGLWQVSHTSRRGLLFLFKNIFSLSSRNFSFYSLQTSMKKPPQPSLIFLIFSFKPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 61914 - protein, 256 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 61915 - protein, 254 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKT

SEQ ID NO: 61916 - protein, 256 aa, Homo sapiens; identical to SEQ ID NO: 61914

SEQ ID NO: 61917 - protein, 156 aa, Homo sapiens
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 61918 - protein, 156 aa, Homo sapiens; identical to SEQ ID NO: 61917

SEQ ID NO: 61919 - protein, 156 aa, Homo sapiens; identical to SEQ ID NO: 61917

SEQ ID NO: 61920 - protein, 156 aa, Homo sapiens; identical to SEQ ID NO: 61917

SEQ ID NO: 61921 - protein, 161 aa, Homo sapiens
MVPKLFTSQICLLLLLGLLAVEGSLHVKPPQFTWAQWFETQHINMTSQQCTNAMQVINNYQRRCKNQNTFLLTTFANVVNVCGNPNMTCPSNKTRKNCHHSGSQVPLIHCNLTTPSPQNISNCRYAQTPANMFYIVACDNRDQRRDPPQYPVVPVHLDRII

SEQ ID NO: 61922 - protein, 160 aa, Homo sapiens
MVPKLFTSQICLLLLLGLMGVEGSLHARPPQFTRAQWFAIQHISLNPPRCTIAMRAINNYRWRCKNQNTFLRTTFANVVNVCGNQSIRCPHNRTLNNCHRSRFRVPLLHCDLINPGAQNISNCTYADRPGRRFYVVACDNRDPRDSPRYPVVPVHLDTTI

SEQ ID NO: 61923 - protein, 147 aa, Homo sapiens
MALQRTHSLLLLLLLTLLGLGLVQPSYGQDGMYQRFLRQHVHPEETGGSDRYCNLMMQRRKMTLYHCKRFNTFIHEDIWNIRSICSTTNIQCKNGKMNCHEGVVKVTDCRDTGSSRAPNCRYRAIASTRRVVIACEGNPQVPVHFDG

SEQ ID NO: 61924 - protein, 147 aa, Homo sapiens; identical to SEQ ID NO: 61923

SEQ ID NO: 61925 - protein, 147 aa, Homo sapiens; identical to SEQ ID NO: 61923

SEQ ID NO: 61926 - protein, 154 aa, Homo sapiens
MAPARAGCCPLLLLLLGLWVAEVLVRAKPKDMTSSQWFKTQHVQPSPQACNSAMSIINKYTERCKDLNTFLHEPFSSVAITCQTPNIACKNSCKNCHQSHGPMSLTMGELTSGKYPNCRYKEKHLNTPYIVACDPPQQGDPGYPLVPVHLDKVV

SEQ ID NO: 61927 - protein, 150 aa, Homo sapiens
MVLCFPLLLLLLVLWGPVCPLHAWPKRLTKAHWFEIQHIQPSPLQCNRAMSGINNYTQHCKHQNTFLHDSFQNVAAVCDLLSIVCKNRRHNCHQSSKPVNMTDCRLTSGKYPQCRYSAAAQYKFFIVACDPPQKSDPPYKLVPVHLDSIL

SEQ ID NO: 61928 - protein, 756 aa, Homo sapiens
MPLRPGSLVPEGAGFPKMAADVSVTHRPPLSPKSGAEVEAGDAAERRAPEEELPPLDPEEIRKRLEHTERQFRNRRKILIRGLPGDVTNQEVHDLLSDYELKYCFVDKYKGTAFVTLLNGEQAEAAINAFHQSRLRERELSVQLQPTDALLCVANLPPSLTQQQFEELVRPFGSLERCFLVYSERTGQSKGYGFAEYMKKDSAARAKSDLLGKPLGPRTLYVHWTDAGQLTPALLHSRCLCVDRLPPGFNDVDALCRALSAVHSPTFCQLACGQDGQLKGFAVLEYETAEMAEEAQQQADGLSLGGSHLRVSFCAPGPPGRSMLAALIAAQATALNRGKGLLPEPNILQLLNNLGPSASLQLLLNPLLHGSAGGKQGLLGAPPAMPLLNGPALSTALLQLALQTQGQKKPGILGDSPLGALQPGAQPANPLLGELPAGGGLPPELPPRRGKPPPLLPSVLGPAGGDREALGLGPPAAQLTPPPAPVGLRGSGLRGLQKDSGPLPTPPGVSLLGEPPKDYRIPLNPYLNLHSLLPASNLAGKEARGWGGAGRSRRPAEGPPTNPPAPGGGSSSSKAFQLKSRLLSPLSSARLPPEPGLSDSYSFDYPSDMGPRRLFSHPREPALGPHGPSRHKMSPPPSGFGERSSGGSGGGPLSHFYSGSPTSYFTSGLQAGLKQSHLSKAIGSSPLGSGEGLLGLSPGPNGHSHLLKTPLGGQKRSFAHLLPSPEPSPEGSYVGQHSQGLGGHYADSYLKRKRIF

SEQ ID NO: 61929 - protein, 606 aa, Homo sapiens
MAADVSVTHRPPLSPKSGAEVEAGDAAERRAPEEELPPLDPEEIRKRLEHTERQFRNRRKILIRGLPGDVTNQEVHDLLSDYELKYCFVDKYKGTAFVTLLNGEQAEAAINAFHQSRLRERELSVQLQPTDALLCVANLPPSLTQQQFEELVRPFGSLERCFLVYSERTGQSKGYGFAEYMKKDSAARAKSDLLGKPLGPRTLYVHWTDAGQLTPALLHSRCLCVDRLPPGFNDVDALCRALSAVHSPTFCQLACGQDGQLKGFAVLEYETAEMAEEAQQQADGLSLGGSHLRVSFCAPGPPGRSMLAALIAAQATALNRGKGLLPEPNILQLLNNLGPSASLQLLLNPLLHGSAGGKQGLLGAPPAMPLLNGPALSTALLQLALQTQGQKKPGILGDSPLGALQPGAQPANPLLGELPAGGGLPPELPPRRGKPPPLLPSVLGPAGGDREALGLGPPAAQLTPPPAPVGLRGSGLRGPLSHFYSGSPTSYFTSGLQAGLKQSHLSKAIGSSPLGSGEGLLGLSPGPNGHSHLLKVRAGGGDMQGWEAPAPQRPLTRPALPSVSRPHWAARNAALPTCCPRPSPAQKAAMWASTPRASAATTRTPT

SEQ ID NO: 61930 - protein, 691 aa, Homo sapiens
MAAAAGDGGGEGGAGLGSAAGLGPGPGLRGQGPSAEAHEGAPDPMPAALHPEEVAARLQRMQRELSNRRKILVKNLPQDSNCQEVHDLLKDYDLKYCYVDRNKRTAFVTLLNGEQAQNAIQMFHQYSFRGKDLIVQLQPTDALLCITNVPISFTSEEFEELVRAYGNIERCFLVYSEVTGHSKGYGFVEYMKKDFAAKARLELLGRQLGASALFAQWMDVNLLASELIHSKCLCIDKLPSDYRDSEELLQIFSSVHKPVFCQLAQDEGSYVGGFAVVEYSTAEQAEEVQQAADGMTIKGSKVQVSFCAPGAPGRSTLAALIAAQRVMHSNQKGLLPEPNPVQIMKSLNNPAMLQVLLQPQLCGRAVKPAVLGTPHSLPHLMNPSISPAFLHLNKAHQSSVMGNTSNLFLQNLSHIPLAQQQLMKFENIHTNNKPGLLGEPPAVVLQTALGIGSVLPLKKELGHHHGEAHKTSSLIPTQTTITAGMGMLPFFPNQHIAGQAGPGHSNTQEKQPATVGMAEGNFSGSQPYLQSFPNLAAGSLLVGHHKQQQSQPKGTEISSGAASKNQTSLLGEPPKEIRLSKNPYLNLASVLPSVCLSSPASKTTLHKTGIASSILDAISQGSESQHALEKCIAYSPPFGDYAQVSSLRNEKRGSSYLISAPEGGSVECVDQHSQGTGAYYMETYLKKKRVY

SEQ ID NO: 61931 - protein, 678 aa, Homo sapiens
MAAAAGDGGGEGGAGLGSAAGLGPGPGLRGQGPSAEAHEGAPDPMPAALHPEEVAARLQRMQRELSNRRKILVKNLPQDSNCQEVHDLLKDYDLKYCYVDRNKRTAFVTLLNGEQAQNAIQMFHQYSFRGKDLIVQLQPTDALLCITNVPISFTSEEFEELVRAYGNIERCFLVYSEVTGHSKGYGFVEYMKKDFAAKARLELLGRQLGASALFAQWMDVNLLASELIHSKCLCIDKLPSDYRDSEELLQIFSSVHKPVFCQLAQDEGSYVGGFAVVEYSTAEQAEEVQQAADGMTIKGSKVQVSFCAPGAPGRSTLAALIAAQRVMHSNQKGLLPEPNPVQIMKSLNNPAMLQVLLQPQLCGRAVKPAVLGTPHSLPHLMNPSISPAFLHLNKAHQNLSHIPLAQQQLMKFENIHTNNKPGLLGEPPAVVLQTALGIGSVLPLKKELGHHHGEAHKTSSLIPTQTTITAGMGMLPFFPNQHIAGQAGPGHSNTQEKQPATVGMAEGNFSGSQPYLQSFPNLAAGSLLVGHHKQQQSQPKGTEISSGAASKNQTSLLGEPPKEIRLSKNPYLNLASVLPSVCLSSPASKTTLHKTGIASSILDAISQGSESQHALEKCIAYSPPFGDYAQVSSLRNEKRGSSYLISAPEGGSVECVDQHSQGTGAYYMETYLKKKRVY

SEQ ID NO: 61932 - protein, 230 aa, Homo sapiens
MTIKGSKVQVSFCAPGAPGRSTLAALIAAQRVMHSNQKGLLPEPNPVQIMKSLNNPAMLQVLLQPQLCGRAVKPAVLGTPHSLPHLMNPSISPAFLHLNKAHQNQTSLLGEPPKEIRLSKNPYLNLASVLPSVCLSSPASKTTLHKTGIASSILDAISQGSESQHALEKCIAYSPPFGDYAQVSSLRNEKRGSSYLISAPEGGSVECVDQHSQGTGAYYMETYLKKKRVY

SEQ ID NO: 61933 - protein, 792 aa, Homo sapiens
MHVIKRDGRQERVMFDKITSRIQKLCYGLNMDFVDPAQITMKVIQGLYSGVTTVELDTLAAETAATLTTKHPDYAILAARIAVSNLHKETKKVFSDVMEDLYNYINPHNGKHSPMVAKSTLDIVLANKDRLNSAIIYDRDFSYNYFGFKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 61934 - protein, 695 aa, Homo sapiens
MEDLYNYINPHNGKHSPMVAKSTLDIVLANKDRLNSAIIYDRDFSYNYFGFKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 61935 - protein, 705 aa, Homo sapiens
DGRQERVMFDKITSRIQKLCYGLNMDFVDPAQITMKVIQGLYSGVTTVELDTLAAETAATLKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 61936 - protein, 454 aa, Homo sapiens
MKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 61937 - protein, 389 aa, Homo sapiens
MLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 61938 - protein, 449 aa, Homo sapiens
MGRVGGMAQPMGRAGAPKPMGRAGSARRGRFKGCWSEGSPVHPVPAVLSWLLALLRCASTMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 61939 - protein, 351 aa, Homo sapiens
MGDPERPEAAGLDQDERSSSDTNESEIKSNEEPLLRKSSRRFVIFPIQYPDIWKMYKQAQASFWTAEEVDLSKDLPHWNKLKADEKYFISHILAFFAASDGIVNENLVERFSQEVQVPEARCFYGFQILIENVHSEMYSLLIDTYIRDPKKREFLFNAIETMPYVKKKADWALRWIADRKSTFGERVVAFAAVEGVFFSGSFAAIFWLKKRGLMPGLTFSNELISRDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 61940 - protein, 299 aa, Homo sapiens
MGDPERPEAAGLDQDEVDLSKDLPHWNKLKADEKYFISHILAFFAASDGIVNENLVERFSQEVQVPEARCFYGFQILIENVHSEMYSLLIDTYIRDPKKREFLFNAIETMPYVKKKADWALRWIADRKSTFGERVVAFAAVEGVFFSGSFAAIFWLKKRGLMPGLTFSNELISRDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 61941 - protein, 139 aa, Homo sapiens
MGDPERPEAAGLDQDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 61942 - protein, 66 aa, Homo sapiens
MGDPERPEAAGLDQDEVFQAENPFDFMENISLEGKTNFFEKRVSEYQRFAVMAETTDNVFTLDADF

SEQ ID NO: 61943 - protein, 43 aa, Homo sapiens
MGDPERPEAAGLDQDERSSSDTNESEIKSNEEPLLRKSSRRSF

SEQ ID NO: 61944 - protein, 297 aa, Homo sapiens
MYKQAQASFWTAEEVDLSKDLPHWNKLKADEKYFISHILAFFAASDGIVNENLVERFSQEVQVPEARCFYGFQILIENVHSEMYSLLIDTYIRDPKKREFLFNAIETMPYVKKKADWALRWIADRKSTFGERVVAFAAVEGVFFSGSFAAIFWLKKRGLMPGLTFSNELISRDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 61945 - protein, 607 aa, Homo sapiens
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 61946 - protein, 435 aa, Homo sapiens
MRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 61947 - protein, 378 aa, Homo sapiens
MTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 61948 - protein, 581 aa, Homo sapiens
MEAPAAGLFLLLLLGTWAPAPGSASSEAPPLINEDVKRTVDLSSHLAKVTAEVVLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 61949 - protein, 631 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKRTAH

SEQ ID NO: 61950 - protein, 345 aa, Homo sapiens
VSPQGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLARVWSTVLESRSLFSKRTVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVG

SEQ ID NO: 61951 - protein, 615 aa, Homo sapiens
MAPPGSSTVFLLALTIIASTWALTPTHYLTKHDVERLKASLDRPFTNLESAFYSIVGLSSLGAQVPDAKISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKRIAAEQSSRLAKYRTLRTAH

SEQ ID NO: 61952 - protein, 146 aa, Homo sapiens
GTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAEQHISSRRKMEILKTECQEKESRTIHSMRRKMEKKNFI

SEQ ID NO: 61953 - protein, 345 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLARVWSTVLESRSLFSKRTVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVG

SEQ ID NO: 61954 - protein, 138 aa, Homo sapiens
ELDTSERKIEFDSASGTYTLYLIIGDATLKNPILWNVADVVIKFPEEEAPSTVLSQNLFTPKQEIQWIRIGANVSNFTFAPSTIIFHLGHAAMLGLMYVYWTQLNMFQTLKYLAILGSVTFLAGNRMLAQQAVKRTAE

SEQ ID NO: 61955 - protein, 138 aa, Homo sapiens
ELDTSERKIEFDSASGTYTLYLIIGDATLKNPILWNVADVVIKFPEEEAPSTVLSQNLFTPKQEIQWIRIGANVSNFTFAPSTIIFHLGHAAMLGLMYVYWTQLNMFQTLKYLAILGSVTFLAGNRMLAQQAVKRTAH

SEQ ID NO: 61956 - protein, 167 aa, Homo sapiens
MQRTVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTS

SEQ ID NO: 61957 - protein, 147 aa, Homo sapiens
  MOD_RES (1)..(1): Any amino acid
XGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAEQHISSRRKMEILKTECQEKESRTIHSMRRKMEKKNFI

SEQ ID NO: 61958 - protein, 311 aa, Homo sapiens
MQRPGPFSTLYGRVLAPLPGRAGGAASGGGGNSWDLPGSHVRLPGRAQSGTRGGAGNTSTSCGDSNSICPAPSTMSKAEEAKKLAGRAAVENHVRNNQVLGIGSGSTIVHAVQRIAERVKQENLNLVCIPTSFQARQLILQYGLTLSDLDRHPEIDLAIDGADEVDADLNLIKGGGGCLTQEKIVAGYASRFIVIADFRKDSKNLGDQWHKGIPIEVIPMAYVPVSRAVSQKFGGVVELRMAVNKAGPVVTDNGNFILDWKFDRVHKWSEVNTAIKMIPGVVDTGLFINMAERVYFGMQDGSVNMREKPFC

SEQ ID NO: 61959 - protein, 177 aa, Homo sapiens
ARQLILQYGLTLSDLDRHPEIDLAIDGADEVDADLNLIKGGGGCLTQEKIVAGYASRFIVIADFRKDSKNLGDQWHKGIPIEVIPMAYVPVSRAVSQKFGGVVELRMAVNKAGPVVTDNGNFILDWKFDRVHKWSEVNTAIKMIPGVVDTGLFINMAERVYFGMQDGSVNMREKPFC

SEQ ID NO: 61960 - protein, 163 aa, Homo sapiens
MRIEKCYFCSGPIYPGHGMMFVRNDCKVFRFCKSKCHKNFKKKRNPRKVRWTKAFRKAAGKELTVDNSFEFEKRRNEPIKYQRELWNKTIDAMKRVEEIKQKRQAKFIMNRLKKNKELQKVQDIKEVKQNIHLIRAPLAGKGKQLEEKMVQQLQEDVDMEDAP

SEQ ID NO: 61961 - protein, 386 aa, Homo sapiens
MCSSVAAKLWFLTDRRIREDYPQKEILRALKAKCCEEELDFRAVVMDEVVLTIEQGNLGLRINGELITAYPQVVVVRVPTPWVQSDSDITVLRHLEKMGCRLMNRPQAILNCVNKFWTFQELAGHGVPLPDTFSYGGHENFAKMIDEAEVLEFPMVVKNTRGHRGKAVFLARDKHHLADLSHLIRHEAPYLFQKYVKESHGRDVRVIVVGGRVVGTMLRCSTDGRMQSNCSLGGVGMMCSLSEQGKQLAIQVSNILGMDVCGIDLLMKDDGSFCVCEANANVGFIAFDKACNLDVAGIIADYAASLLPSGRLTRRMSLLSVVSTASETSEPELGPPASTAVDNMSASSSSVDSDPESTERELLTKLPGGLFNMNQLLANEIKLLVD

SEQ ID NO: 61962 - protein, 386 aa, Homo sapiens; identical to SEQ ID NO: 61961

SEQ ID NO: 61963 - protein, 386 aa, Homo sapiens; identical to SEQ ID NO: 61961

SEQ ID NO: 61964 - protein, 95 aa, Homo sapiens
MCSSVAAKLWFLTDRRIREDYPQKEILRALKAKCCEEELDFRAVVMDEVVLTIEQGNLGLRINGELITAYPQVVVVRVPTPWVQSDSDITVLRHL

SEQ ID NO: 61965 - protein, 114 aa, Homo sapiens
MCSSVAAKLWFLTDRRIREDYPQKEILRALKAKCCEEELDFRAVVMDEVVLTIEQGNLGLRINGELITAYPQVVVVRVPTPWVQSDSDITVLRHLEKMGCRLMNRPQAILNCVN

SEQ ID NO: 61966 - protein, 214 aa, Homo sapiens
MGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPNRGPLDKWRALHS

SEQ ID NO: 61967 - protein, 214 aa, Homo sapiens; identical to SEQ ID NO: 61966

SEQ ID NO: 61968 - protein, 214 aa, Homo sapiens; identical to SEQ ID NO: 61966

SEQ ID NO: 61969 - protein, 201 aa, Homo sapiens
MGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIP

SEQ ID NO: 61970 - protein, 108 aa, Homo sapiens
PKSRFCRGVPDAKIRIFDLGRKKAKVDEFPLCGHMVSDEYEQLSSEALEAARICANKYMVKSCGKDGFHIRVRLHPFHVIRINKMLSCAGADRPTLLCQCWETSRNTS

SEQ ID NO: 61971 - protein, 181 aa, Homo sapiens
MGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRSTSQRSGASPSSMLMNLKTWWLKSGSSQMAVGSSTSPIVALWTSGGPCTHEGFQCAAPLLILTNKFYFLST

SEQ ID NO: 61972 - protein, 178 aa, Homo sapiens [sequence omitted]

SEQ ID NO: 61973 - protein, 131 aa, Homo sapiens
QDQGEKENPMRELRIRKLCLNICVGESGDRLTRAAKVLEQLTGQTPVFSKARYTVRSFGIRRNEKIAVHCTVRGAKAEEILEKGLKVREYELRKNNFSDTGNFGFGIQEHIDLGIKYDPSIGIYGLDFYVV

SEQ ID NO: 61974 - protein, 174 aa, Homo sapiens
QDQGEKENPMRELRIRKLCLNICVGESGDRLTRAAKVLEQLTGQTPVFSKARYTVRSFGIRRNEKIAVHCTVRGAKAEEILEKGLKVREYELRKNNFSDTGNFGFGIQEHIDLGIKYDPSIGIYGLDFYVVLGRPGFSIADKKRRTGCIGAKHRISKEEAMRWFQQKVKLIYLK

SEQ ID NO: 61975 - protein, 165 aa, Homo sapiens [sequence omitted]

SEQ ID NO: 61976 - protein, 132 aa, Homo sapiens
MPPKFDPNEIKVVYLRCTGGEVGATSALAPKIGPLGLIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 61977 - protein, 211 aa, Homo sapiens [sequence omitted]

SEQ ID NO: 61978 - protein, 211 aa, Homo sapiens [sequence omitted]

SEQ ID NO: 61979 - protein, 164 aa, Homo sapiens
MAPSRNGMVLKPHFHKDWQRRVATWFNQPARKIRRRKARQAKARRIAPRPASGPIRPIVRCPTVRYHTKVRAGRGFSLEELRVAGIHKKGDSSAEELKLATQLTGPVMPVRNVYKKEKARVITEEEKNFKAFASLRMARANARLFGIRAKRAKEAAEQDVEKKK

SEQ ID NO: 61980 - protein, 204 aa, Homo sapiens [sequence omitted]

SEQ ID NO: 61981 - protein, 204 aa, Homo sapiens [sequence omitted]

SEQ ID NO: 61982 - protein, 175 aa, Homo sapiens
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEVNAGRHCGALRVLNSYWVGEDSTYKFFEVILIDPFHKAIRRNPDTQWITKPVHKHREMRGLTSAGRKSRGLG

SEQ ID NO: 61983 - protein, 204 aa, Homo sapiens [sequence omitted]

SEQ ID NO: 61984 - protein, 204 aa, Homo sapiens [sequence omitted]

SEQ ID NO: 61985 - protein, 133 aa, Homo sapiens
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVLNSYWVGEDSTYKFFEVI

SEQ ID NO: 61986 - protein, 174 aa, Homo sapiens
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVLNSYWVGEDSTYKFFEVILIDPFHKAIRRNPDTQWITKPVHKHREMRGLTSAGRKSRGL

SEQ ID NO: 61987 - protein, 204 aa, Homo sapiens [sequence omitted]

SEQ ID NO: 61988 - protein, 59 aa, Homo sapiens
MGAYKYIQELWRKKQSDVMRFLLRVRCWQYRQLSALHRAPRPTRPDKARRLGYKAKQGT

SEQ ID NO: 61989 - protein, 145 aa, Homo sapiens
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVLNSYWMESHSHSGGSAVGQSRLTATSVSRV

SEQ ID NO: 61990 - protein, 164 aa, Homo sapiens
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVHKHREMRGLTSAGRKSRGLGKGHKFHHTIGGSRRAAWRRRNTLQLHRYR

SEQ ID NO: 61991 - protein, 146 aa, Homo sapiens
MHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARE

SEQ ID NO: 61992 - protein, 184 aa, Homo sapiens [sequence omitted]

SEQ ID NO: 61993 - protein, 184 aa, Homo sapiens [sequence omitted]

SEQ ID NO: 61994 - protein, 190 aa, Homo sapiens
  MOD_RES (1)..(1): Any amino acid
XPQGVDIRHNKDRKVRRKEPKSQDIYLRLLVKLYRFLARRTNSTFNQVVLKRLFMSRTNRPPLSLSRMIRKMKLPGRENKTAVVVGTITDDVRVQEVPKLKVCALRVTSRARSRILRAGGKILTFDQLALDSPKGCGTVLLSGPRKGREVYRHFGKAPGTPHSHTKPYVRSKGRKFERARGRRASRGYKN

SEQ ID NO: 61995 - protein, 135 aa, Homo sapiens
MGVDIRHNKDRKVRRKEPKSQDIYLRLLVKLYRFLARRTNSTFNQVVLKRLFMSRTNRPPLSLSRMIRKMKLPGRENKTAVVVGTITDDVRVQEVPKLKVSWRGLGRPIRPLLYCAVLCCAVLCCLVHPQSCHRW

SEQ ID NO: 61996 - protein, 188 aa, Homo sapiens [sequence omitted]

SEQ ID NO: 61997 - protein, 159 aa, Homo sapiens
MLYRFLARRTNSTFNQVVLKRLFMSRTNRPPLSLSRMIRKMKLPGRENKTAVVVGTITDDVRVQEVPKLKVCALRVTSRARSRILRAGGKILTFDQLALDSPKGCGTVLLSGPRKGREVYRHFGKAPGTPHSHTKPYVRSKGRKFERARGRRASRGYKN

SEQ ID NO: 61998 - protein, 176 aa, Homo sapiens [sequence omitted]

SEQ ID NO: 61999 - protein, 154 aa, Homo sapiens [sequence omitted]

SEQ ID NO: 62000 - protein, 196 aa, Homo sapiens [sequence omitted]

SEQ ID NO: 62001 - protein, 160 aa, Homo sapiens [sequence omitted]

SEQ ID NO: 62002 - protein, 160 aa, Homo sapiens [sequence omitted]

SEQ ID NO: 62003 - protein, 160 aa, Homo sapiens [sequence omitted]

SEQ ID NO: 62004 - protein, 160 aa, Homo sapiens [sequence omitted]

SEQ ID NO: 62005 - protein, 128 aa, Homo sapiens [sequence omitted]

SEQ ID NO: 62006 - protein, 91 aa, Homo sapiens
MAGSRRECRRGGSSGAKFRISLGLPVGAVINCADNTGAKNLYIISVKGIKGRLNRLPAAGVGDMVMATVKKGKPELRKKVHPAVVIRQRKS

SEQ ID NO: 62007 - protein, 140 aa, Homo sapiens [sequence omitted]

SEQ ID NO: 62008 - protein, 114 aa, Homo sapiens
MSKRGRGGSSGAKFRISLGLPVGAVINCADNTGAKNLYIISVKGIKGRLNRLPAAGVGDMVMATVKKGKPELRKKVLLCHTGWSAVTPLKLTVTLNCWTWNPPAVAFKGLQLQV

SEQ ID NO: 62009 - protein, 140 aa, Homo sapiens [sequence omitted]

SEQ ID NO: 62010 - protein, 158 aa, Homo sapiens
  MOD_RES (1)..(1): Any amino acid
XLVGAPCPRASPAPPKAEAKAKALKAKKAVLKGVHSHKKKKIRTSPTFRRPKTLRLRRQPKYPRKSAPRRNKLDHYAIIKFPLTTESAMKKIEDNNTLVFIVDVKANKHQIKQAVKKLYDIDVAKVNTLIRPDGEKKAYVRLAPDYDALDVANKIGII

SEQ ID NO: 62011 - protein, 158 aa, Homo sapiens
MSPGLVVLRWAPAPPKAEAKAKALKAKKAVLKGVHSHKKKKIRTSPTFRRPKTLRLRRQPKYPRKSAPRRNKLDHYAIIKFPLTTESAMKKIEDNNTLVFIVDVKANKHQIKQAVKKLYDIDVAKVNTLIRPDGEKKAYVRLAPDYDALDVANKIGII

SEQ ID NO: 62012 - protein, 194 aa, Homo sapiens
MHPLVGAPCPRACKELVPSALTIFLLVHVQPGYITRPSLRSVVLRWAPAPPKAEAKAKALKAKKAVLKGVHSHKKKKIRTSPTFRRPKTLRLRRQPKYPRKSAPRRNKLDHYAIIKFPLTTESAMKKIEDNNTLVFIVDVKANKHQIKQAVKKLYDIDVAKVNTLIRPDGEKKAYVRLAPDYDALDVANKIGII

SEQ ID NO: 62013 - protein, 156 aa, Homo sapiens [sequence omitted]

SEQ ID NO: 62014 - protein, 157 aa, Homo sapiens [sequence omitted]

SEQ ID NO: 62015 - protein, 150 aa, Homo sapiens
MKVELCSFSGYKIYPGHGRRYARTDGKVFQFLNAKCESAFLSKRNPRQINWTVLYRRKHKKGQSEEIQKKRTRRAVKFQRAITGASLADIMAKRNQKPEVRKAQREQAIRAAKEAKKAKQASKKTAMAAAKVIMGFLYFLEQYNRKIFFF

SEQ ID NO: 62016 - protein, 145 aa, Homo sapiens [sequence omitted]

SEQ ID NO: 62017 - protein, 136 aa, Homo sapiens [sequence omitted]

SEQ ID NO: 62018 - protein, 148 aa, Homo sapiens [sequence omitted]

SEQ ID NO: 62019 - protein, 108 aa, Homo sapiens
MPSRLRKTRKLRGHVSHGHGRIGKHRKHPGGRGNAGGLHHHRINFDKYHPGYFGKVGMKHYHLKRNQSFCPTVNLDKLWTLVSEQTRVNAAKNKTGAAPIIDVVRSVS

SEQ ID NO: 62020 - protein, 137 aa, Homo sapiens [sequence omitted]

SEQ ID NO: 62021 - protein, 69 aa, Homo sapiens
MSAHLQWMVVRNCSSFLIKRNKQTYSTEPNNLKARNSFRYNGLIHRKTVGVEPAADGKGVVVVIKRRSE

SEQ ID NO: 62022 - protein, 87 aa, Homo sapiens
MSAHLQWMVVRNCSSFLIKRNKQTYSTEPNNLKARNSFRYNGLIHRKTVGVEPAADGKGVVVVIKRRSGEFCLVWARERPLSRVWEL

SEQ ID NO: 62023 - protein, 169 aa, Homo sapiens
MSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMDMLASTGSGLCCSVAVQPWASSSTSLCLRTLICNMRVDRPYYSGLMRRLNVQNLLDCAHKS

SEQ ID NO: 62024 - protein, 169 aa, Homo sapiens; identical to SEQ ID NO: 62023

SEQ ID NO: 62025 - protein, 137 aa, Homo sapiens [sequence omitted]

SEQ ID NO: 62026 - protein, 163 aa, Homo sapiens
MSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMVSWGLGIRLGETGQCCGEGPPTTGCNMGWRGMDSCFQPTPHTQHWPRGRLVECMG

SEQ ID NO: 62027 - protein, 159 aa, Homo sapiens [sequence omitted]

SEQ ID NO: 62028 - protein, 159 aa, Homo sapiens [sequence omitted]

SEQ ID NO: 62029 - protein, 159 aa, Homo sapiens [sequence omitted]

SEQ ID NO: 62030 - protein, 159 aa, Homo sapiens [sequence omitted]

SEQ ID NO: 62031 - protein, 159 aa, Homo sapiens [sequence omitted]

SEQ ID NO: 62032 - protein, 159 aa, Homo sapiens [sequence omitted]

SEQ ID NO: 62033 - protein, 403 aa, Homo sapiens
MSHRKFSAPRHGSLGFLPRKRSSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 62034 - protein, 351 aa, Homo sapiens
MTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 62035 - protein, 115 aa, Homo sapiens [sequence omitted]

SEQ ID NO: 62036 - protein, 115 aa, Homo sapiens [sequence omitted]

SEQ ID NO: 62037 - protein, 114 aa, Homo sapiens
MVAAKKTKKSLESINSRLQLVMKSGKYVLGYKQTLKMIRQGKAKLVILANNCPALRKSEIEYYAMLAKTGVHHYSGNNIELGTACGKYYRVCTLAIIDPGDSDIIRSMPEQTGE

SEQ ID NO: 62038 - protein, 94 aa, Homo sapiens
MSGRLWSKAIFAGYKRGLRNQREHTALLKIEGVYARDETEFYLGKRCAYVYKAKNNTVTPGGKPNKTRVIWGKVTRAHGNSGMVRAKFRSNLPA

SEQ ID NO: 62039 - protein, 110 aa, Homo sapiens [sequence omitted]

SEQ ID NO: 62040 - protein, 110 aa, Homo sapiens [sequence omitted]

SEQ ID NO: 62041 - protein, 131 aa, Homo sapiens
  MOD_RES (1)..(1): Any amino acid
XLPFASRFLSFRADSAHASMVNVPKTRRTFCKKCGKHQPHKVTQYKKGKDSLYAQGKRRYDRKQSGYGGQTKPIFRKKAKTTKKIVLRLECVEPNCRSKRMLAIKRCKHFELGGDKKRKVYNYGWKVQSFS

SEQ ID NO: 62042 - protein, 142 aa, Homo sapiens
MIAPTDSHEEVRSGTSYILPFASRFLSFRADSAHASMVNVPKTRRTFCKKCGKHQPHKVTQYKKGKDSLYAQGKRRYDRKQSGYGGQTKPIFRKKAKTTKKIVLRLECVEPNCRSKRMLAIKRCKHFELGGDKKRKGQVIQF

SEQ ID NO: 62043 - protein, 106 aa, Homo sapiens [sequence omitted]

SEQ ID NO: 62044 - protein, 106 aa, Homo sapiens
MVNVPKTRRTFCKKCGKHQPHKVTQYKKGKDSLYAQGRRRYDRKQSGYGGQTKPIFRKKAKTTKKIVLRLECVEPNCRSKRMLAIKRCKHFELGGDKKRKGQVIQF

SEQ ID NO: 62045 - protein, 97 aa, Homo sapiens [sequence omitted]

SEQ ID NO: 62046 - protein, 68 aa, Homo sapiens
MVKKIEISQHAKYTCSFCGKTKMKRRAVGIWHCGSCMKTVAGGAWTYNTTSAVTVKSAIRRLKELKDQ

SEQ ID NO: 62047 - protein, 92 aa, Homo sapiens [sequence omitted]

SEQ ID NO: 62048 - protein, 70 aa, Homo sapiens [sequence omitted]

SEQ ID NO: 62049 - protein, 70 aa, Homo sapiens [sequence omitted]

SEQ ID NO: 62050 - protein, 70 aa, Homo sapiens [sequence omitted]

SEQ ID NO: 62051 - protein, 51 aa, Homo sapiens
MSSHKTFTIKRFLAKKQKQNRPIPQWIQMKPGSKIRYNSKRRHWRRTKLGL

SEQ ID NO: 62052 - protein, 51 aa, Homo sapiens; identical to SEQ ID NO: 62051

SEQ ID NO: 62053 - protein, 51 aa, Homo sapiens; identical to SEQ ID NO: 62051

SEQ ID NO: 62054 - protein, 427 aa, Homo sapiens [sequence omitted]

SEQ ID NO: 62055 - protein, 406 aa, Homo sapiens
MACARPLISVYSEKGESSGKNVTLPAVFKAPIRPDIVNFVHTNLRKNNRQPYAVSELAGHQTSAESWGTGRAVARIPRVRGGGTHRSGQGAFGNMCRGGRMFAPTKTWRRWHRRVNTTQKRYAICSALAASALPALVMSKGHRIEEVPELPLVVEDKVEGYKKTKEAVLLLKKLKAWNDIKKVYASQRMRAGKGKMRNRRRIQRRGPCIIYNEDNGIIKAFRNIPGITLLNVSKLNILKLAPGGHVGRFCIWTESAFRKLDELYGTWRKAASLKSNYNLPMHKMINTDLSRILKSPEIQRALRAPRKKIHRRVLKKNPLKNLRIMLKLNPYAKTMRRNTILRQARNHKLRVDKAAAAAAALQAKSDEKAAVAGKKPVVGKKGKKAAVGEKKPAEKKPTTEEKKPAA

SEQ ID NO: 62056 - protein, 151 aa, Homo sapiens
MACARPLISVYSEKGESSGKNVTLPAVFKAPIRPDIVNFVHTNLRKNNRQPYAVSELAGHQTSAESWGTGRAVARIPRVRGGGTHRSGQGAFGNMCRGGRMFAPTKTWRRWHRRVNTTQKLENHVEAKPICKDHAPEHHSSPGQESQAPGG

SEQ ID NO: 62057 - protein, 25 aa, Homo sapiens [sequence omitted]

SEQ ID NO: 62058 - protein, 25 aa, Homo sapiens [sequence omitted]

SEQ ID NO: 62059 - protein, 126 aa, Homo sapiens
MIVRVTNRDIICQIAYARIEGDMIVCAAYAHELPKYGVKVGLTNYAAAYCTGLLLARRLLNRFGMDKIYEGQVEVTGDEYNVESIDGQPGAFTCYLDAGLARTTTGNKVFGALKGAVDGGLSIPHR

SEQ ID NO: 62060 - protein, 297 aa, Homo sapiens [sequence omitted]

SEQ ID NO: 62061 - protein, 247 aa, Homo sapiens
MIVRVTNRDIICQIAYARIEGDMIVCAAYAHELPKYGVKVGLTNYAAAYCTGLLLARRLLNRFGMDKIYEGQVEVTGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNSVTPDMMEEMYKKAHAAIRENPVYEKKPKKEVKKKRWNRPKMSLAQKKDRVAQKKASFLRAQERAAES

SEQ ID NO: 62062 - protein, 288 aa, Homo sapiens [sequence omitted]

SEQ ID NO: 62063 - protein, 288 aa, Homo sapiens [sequence omitted]

SEQ ID NO: 62064 - protein, 105 aa, Homo sapiens
MAGEKVEKPDTKEKKPEAKKVDAGGKVKKGNLKAKKPKKGKPHCSRNPVLVRGIGRYSRSAMYSRKAMYKRKYSAAKSKVEKKKKEKVLATVTKPVGGDKNGGTR

SEQ ID NO: 62065 - protein, 72 aa, Homo sapiens
MAGEKVEKPDTKEKKPEAKKVDAGGKVKKGNLKAKKPKKGKPHCSRNPVLVRGIGRYSRSAMYSRKAMYKRK

SEQ ID NO: 62066 - protein, 159 aa, Homo sapiens
MAGEKVEKPDTKEKKPEAKKVDAGGKVKKGNLKAKKPKKGKPHCSRNPVLVRGIGRYSRSAMYSRKAMYKRKYSAAKSKVEKKKKEKVLATVTKPVGGDKNGGTRVVKLRKMPRYYPTEDVPRKLLSHGKKPFSQHVRKLRASITPGTILIILTGRHRG

SEQ ID NO: 62067 - protein, 114 aa, Homo sapiens
MAGEKVEKPDTKEKKPEAKKVDAGGKVKKGNLKAKKPKKGKPHCSRNPVLVRGIGRYSRSAMYSRKAMYKRKYSAAKSKVEKKKKEKVLATVTKPVGGDKNGGTRVVKLRKMVR

SEQ ID NO: 62068 - protein, 114 aa, Homo sapiens; identical to SEQ ID NO: 62067

SEQ ID NO: 62069 - protein, 248 aa, Homo sapiens
MEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTFVKLNKASINMLRIVEPYIAWGYPNLKSVNELIYKRGYGKINKKRIALTDNALIARSLGKYGIICMEDLIHEIYTVGKRFKEANNFLWPFKLSSPRGGMKKKTTHFVEGGDAGNREDQINRLIRRMN

SEQ ID NO: 62070 - protein, 151 aa, Homo sapiens
MAPLYQAAGKGDVPTKRPPVLRAGVNTVTTLVENKKAQLVVIAHDVDPIELVVFLPALCRKMGVPYCIIKGKARLGRLVHRKTCTTVAFTQVNSEDKGALAKLVEAIRTNYNDRYDEIRRHWGGNVLGPKSVARIAKLEKAKAKELATKLG

SEQ ID NO: 62071 - protein, 266 aa, Homo sapiens [sequence omitted]

SEQ ID NO: 62072 - protein, 191 aa, Homo sapiens
MLVRLNVRCSCRGVVLGGCRKLLASLVQPKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPI

SEQ ID NO: 62073 - protein, 257 aa, Homo sapiens [sequence omitted]

SEQ ID NO: 62074 - protein, 257 aa, Homo sapiens [sequence omitted]

SEQ ID NO: 62075 - protein, 192 aa, Homo sapiens [sequence omitted]

SEQ ID NO: 62076 - protein, 147 aa, Homo sapiens
MKTILSNQTVDIPENVDITLKGRTVIVKGPRGTLRRDFNHINVELSLLGKKKKRLRVDKWWGNRKELATVRTICSHVQNMIKGVTLGFRYKMRSVYAHFPINVVIQENGSLVEIRNFLGEKYIRRVRMRPGVACFKFSGFDSASHNS

SEQ ID NO: 62077 - protein, 192 aa, Homo sapiens [sequence omitted]

SEQ ID NO: 62078 - protein, 166 aa, Homo sapiens
MKTILSNQTVDIPENVDITLKGRTVIVKGPRGTLRRDFNHINVELSLLGKKKKRLRVDKWWGNRKELATVRTICSHVQNMIKGVTLGFRYKMRSVYAHFPINVVIQENGSLVEIRNFLGEKYIRRVRMRPGVACSVSQAQKDELILEGNDIELVSNSAALIQQATT

SEQ ID NO: 62079 - protein, 165 aa, Homo sapiens
MLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 62080 - protein, 158 aa, Homo sapiens [sequence omitted]

SEQ ID NO: 62081 - protein, 132 aa, Homo sapiens [sequence omitted]

SEQ ID NO: 62082 - protein, 151 aa, Homo sapiens [sequence omitted]

SEQ ID NO: 62083 - protein, 151 aa, Homo sapiens [sequence omitted]

SEQ ID NO: 62084 - protein, 151 aa, Homo sapiens [sequence omitted]

SEQ ID NO: 62085 - protein, 151 aa, Homo sapiens [sequence omitted]

SEQ ID NO: 62086 - protein, 151 aa, Homo sapiens [sequence omitted]

SEQ ID NO: 62087 - protein, 145 aa, Homo sapiens [sequence omitted]

SEQ ID NO: 62088 - protein, 145 aa, Homo sapiens [sequence omitted]

SEQ ID NO: 62089 - protein, 130 aa, Homo sapiens [sequence omitted]

SEQ ID NO: 62090 - protein, 130 aa, Homo sapiens [sequence omitted]

SEQ ID NO: 62091 - protein, 146 aa, Homo sapiens [sequence omitted]

SEQ ID NO: 62092 - protein, 152 aa, Homo sapiens
MPSKGPLQSVQVFGRKKTATAVAHCKRGNGLIKVNGRPLEMIEPRTLQYKLLEPVLLLGKERFAGVDIRVRVKGGGHVAQIYGESQELGAWRRWLWEGGLHSAPVPFNCVSFSQLSVSPSPKPWWPITRNMWMRLPRRRSKTSSSSMTGPCW

SEQ ID NO: 62093 - protein, 135 aa, Homo sapiens [sequence omitted]

SEQ ID NO: 62094 - protein, 152 aa, Homo sapiens [sequence omitted]

SEQ ID NO: 62095 - protein, 152 aa, Homo sapiens [sequence omitted]

SEQ ID NO: 62096 - protein, 152 aa, Homo sapiens [sequence omitted]

SEQ ID NO: 62097 - protein, 34 aa, Homo sapiens
MSLVIPEKFQHILRVLNTNIDGRRKIAFAITAIK

SEQ ID NO: 62098 - protein, 152 aa, Homo sapiens [sequence omitted]

SEQ ID NO: 62099 - protein, 152 aa, Homo sapiens [sequence omitted]

SEQ ID NO: 62100 - protein, 82 aa, Homo sapiens
MQNPRQYKIPDWFLNRQKDVKDGKYSQVLANGLDNKLREDLERLKKIRAHRGLRHFWGLRVRGQHTKTTGRRGRTVGVSKKK

SEQ ID NO: 62101 - protein, 82 aa, Homo sapiens; identical to SEQ ID NO: 62100

SEQ ID NO: 62102 - protein, 82 aa, Homo sapiens; identical to SEQ ID NO: 62100

SEQ ID NO: 62103 - protein, 82 aa, Homo sapiens; identical to SEQ ID NO: 62100

SEQ ID NO: 62104 - protein, 82 aa, Homo sapiens; identical to SEQ ID NO: 62100

SEQ ID NO: 62105 - protein, 145 aa, Homo sapiens [sequence omitted]

SEQ ID NO: 62106 - protein, 145 aa, Homo sapiens [sequence omitted]

SEQ ID NO: 62107 - protein, 136 aa, Homo sapiens
MSAALLRRGLELLAASEAPRDPPGQAKPRGAPVKRPRKTKAIQAQKLRNSAKGKVPKSALDEYRKRECRDHLRVNLKFLTRTRSTVAESVSQQILRQNRGRKACDRPVAKTKKKKAEGTVFTEEDFQKFQQEYFGS

SEQ ID NO: 62108 - protein, 293 aa, Homo sapiens [sequence omitted]

SEQ ID NO: 62109 - protein, 235 aa, Homo sapiens
MADDAGAAGGPGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 62110 - protein, 178 aa, Homo sapiens [sequence omitted]

SEQ ID NO: 62111 - protein, 195 aa, Homo sapiens
VTKLGRLVKDMKIKSLEEIYLFSLPIKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 62112 - protein, 119 aa, Homo sapiens [sequence omitted]

SEQ ID NO: 62113 - protein, 142 aa, Homo sapiens
MAFKDTGKTPVEPEVAIHRIRITLTSRNVKSLEKVCADLIRGAKEKNLKVKGPVRMPTKTLRITTRKTPCGEGSKTWDRFQMRIHKRLIDLHSPSEIVKQITSISIEPGVELIESTDAEPMDTEGQQYTLRSVFESPGTCPF

SEQ ID NO: 62114 - protein, 119 aa, Homo sapiens [sequence omitted]

SEQ ID NO: 62115 - protein, 83 aa, Homo sapiens
MQNDAGEFVDLYVPRKCSASNRIIGAKDHASIQMNVAEVDKVTGRFNGQFKTYAICGAIRRMGESDDSILRLAKADGIVSKNF

SEQ ID NO: 62116 - protein, 97 aa, Homo sapiens
MQNDAGEFVDLYVPRKCSASNRIIGAKDHASIQMNVARLTRSQAGLMASLKLMLSAGPFVGWVSQMIPFSDWPRRWHRLKELLTGENHRCGIFVINK

SEQ ID NO: 62117 - protein, 83 aa, Homo sapiens; identical to SEQ ID NO: 62115

SEQ ID NO: 62118 - protein, 66 aa, Homo sapiens
MQNDAGEFVDLYVPRKCSASNRIIGAKDHASIQMNVAEVSWEPGRREGCDICAGKAGCPIVEEPLG

SEQ ID NO: 62119 - protein, 90 aa, Homo sapiens
MQNDAGEFVDLYVPRKCSASNRIIGAKDHASIQMNVAEVDKVTGRFNGQFKTYAICGAIRRMVSVSLGFAHHFGTSWTLPCALECVMVPE

SEQ ID NO: 62120 - protein, 81 aa, Homo sapiens
MQNDAGEFVDLYVPRKCSASNRIIGAKDHASIQMNVAEVDKVTGRFNGQFKTYAICGAIRRMGESDDSILRLAKADGIVSK

SEQ ID NO: 62121 - protein, 143 aa, Homo sapiens [sequence omitted]

SEQ ID NO: 62122 - protein, 130 aa, Homo sapiens
MNDTVTIRTRKFMTNRLLQRKQMVIDVLHPGKATVPKTEIREKLAKMYKTTPDVIFVFGFRTHFGGGKTTGFGMIYDSLDYAKKNEPKHRLARHGLYEKKKTSRKQRKERKNRMKKVRGTAKANVGAGKK

SEQ ID NO: 62123 - protein, 133 aa, Homo sapiens [sequence omitted]

SEQ ID NO: 62124 - protein, 132 aa, Homo sapiens
MNDTVTIRTRKFMTNRLLQRKQMVIDVLHPGKATVPKTEIREKLAKMYKTTPDVIFVFGFRTHFGGGKTTGFGMIYDSLDYAKKNEPKHRLARHGLYEKKKTSRKQRKERKNRMKKVRGTAKANVGAGKKQK

SEQ ID NO: 62125 - protein, 131 aa, Homo sapiens
MNDTVTIRTRKFMTNRLLQRKQMVIDVLHPGKATVPKTEIREKLAKMYKTTPDVIFVFGFRTHFGGGKTTGFGMIYDSLDYAKKNEPKHRLARHGLYEKKKTSRKQRKERKNRMKKVRGTAKANVGAGKKQ

SEQ ID NO: 62126 - protein, 289 aa, Homo sapiens
MNDTVTIRTRKFMTNRLLQRKQMVIDVLHPGKATVPKTEIREKLAKMYKTTPDVIFVFGFRTHFGGGKTTGFGMIYDSLDYAKKNEPKHRLARHGLYEKKKTSRKQRKERKNRMKKVRGTAKANVGAGKKMRELGLGVQALGRISQEERCTDVKNSKARESRGVVWQVEVPGPWSVWTCGRLRRGCGKYLQVAVTWRKTENREQCCQACLLERALVRNGAFMSPASPAPAGSPHPVDGDLVLHLPEALSATLTLSPHIQAINKSFGPFFEIHQESSCFSPPSCLSGLGH

SEQ ID NO: 62127 - protein, 125 aa, Homo sapiens [sequence omitted]

SEQ ID NO: 62128 - protein, 115 aa, Homo sapiens [sequence omitted]

SEQ ID NO: 62129 - protein, 115 aa, Homo sapiens [sequence omitted]

SEQ ID NO: 62130 - protein, 84 aa, Homo sapiens
MPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 62131 - protein, 66 aa, Homo sapiens
MPLAKDLLHPSPEEEKRKHKKKRLVQSPNSYFMDVKCPGEETACCSGESTGPQQLENVVVLAVSYP

SEQ ID NO: 62132 - protein, 84 aa, Homo sapiens
MPLARDLLHPSLEEEKKKHKKKRLVQSPNSYFMDVKCPGCYKITTVFSHAQTVVLCVGCSTVLCQPTGGKARLTEGCSFRRKQH

SEQ ID NO: 62133 - protein, 52 aa, Homo sapiens
MDVKCPGCYKITTVFSHAQTVVLCVGCSTVLCQPTGGKARLTEGCSFRRKQH

SEQ ID NO: 62134 - protein, 52 aa, Homo sapiens; identical to SEQ ID NO: 62133

SEQ ID NO: 62135 - protein, 100 aa, Homo sapiens
MCQRCGLKLIVIICFFVQLARDLLHPSLEEEKKKHKKKRLVQSPNSYFMDVKCPGCYKITTVFSHAQTVVLCVGCSTVLCQPTGGKARLTEGCSFRRKQH

SEQ ID NO: 62136 - protein, 69 aa, Homo sapiens [sequence omitted]

SEQ ID NO: 62137 - protein, 121 aa, Homo sapiens
MVPFNDLYSGPDTFSEFISASHSAVPFRGPPLLLPPLRWGPVGARGIHGRHEPIHHPQCKRPRARGRRAHPFGVRARSPEVALSLAARWVLDVGFDHLADGNGLSQSAPFFCPPHVTEMLL

SEQ ID NO: 62138 - protein, 69 aa, Homo sapiens [sequence omitted]

SEQ ID NO: 62139 - protein, 56 aa, Homo sapiens [sequence omitted]

SEQ ID NO: 62140 - protein, 67 aa, Homo sapiens
MGHQQLYWSHPRKFGQGSRSCRVCSNRHGLIRKYGLNMCRQCFRQYAKDIGFIKKDLSCLPWHCLWR

SEQ ID NO: 62141 - protein, 259 aa, Homo sapiens
MAVQISKKRKFVADGIFKAELNEFLTRELAEDGYSGVEVRVTPTRTEIIILATRTQNVLGEKGRRIRELTAVVQKRFGFPEGSVELKIMVMVTGYPLLPLKLYAEKVATRGLCAIAQAESLRYKLLGGLAVRRACYGVLRFIMESGAKGCEVVVSGKLRGQRAKSMKFVDGLMIHSGDPVNYYVDTAVRHVLLRQGVLGIKVKIMLPWDPTGKIGPKKPLPDHVSIVEPKDEILPTTPISEQKGGKPEPPAMPQPVPTA

SEQ ID NO: 62142 - protein, 243 aa, Homo sapiens
MAVQISKKRKFVADGIFKAELNEFLTRELAEDGYSGVEVRVTPTRTEIIILATRTQNVLGEKGRRIRELTAVVQKRFGFPEGSVELYAEKVATRGLCAIAQAESLRYKLLGGLAVRRACYGVLRFIMESGAKGCEVVVSGKLRGQRAKSMKFVDGLMIHSGDPVNYYVDTAVRHVLLRQGVLGIKVKIMLPWDPTGKIGPKKPLPDHVSIVEPKDEILPTTPISEQKGGKPEPPAMPQPVPTA

SEQ ID NO: 62143 - protein, 243 aa, Homo sapiens; identical to SEQ ID NO: 62142

SEQ ID NO: 62144 - protein, 243 aa, Homo sapiens; identical to SEQ ID NO: 62142

SEQ ID NO: 62145 - protein, 264 aa, Homo sapiens [sequence omitted]

SEQ ID NO: 62146 - protein, 175 aa, Homo sapiens
MAVAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKL

SEQ ID NO: 62147 - protein, 227 aa, Homo sapiens
MFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 62148 - protein, 145 aa, Homo sapiens
MIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 62149 - protein, 227 aa, Homo sapiens; identical to SEQ ID NO: 62147

SEQ ID NO: 62150 - protein, 208 aa, Homo sapiens
KRLTKGGKKGAKKKVVDPFSKKDWYDVKAPAMFNIRNIGKTLVTRTQGTKIASDGLKGRVFETMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 62151 - protein, 263 aa, Homo sapiens [sequence omitted]

SEQ ID NO: 62152 - protein, 122 aa, Homo sapiens
MARGPKKHLKRVAAPKHWMLDKLTGVFAPRPSTGPHKLRECLPLIIFLRNRLKYALTGDEVKKICMQRFIKIDGKVRTDITYPAGFMDVISIDKTGENFRLIYDTKGRFAVHRITPEEAKPC

SEQ ID NO: 62153 - protein, 263 aa, Homo sapiens
MARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQSSG

SEQ ID NO: 62154 - protein, 262 aa, Homo sapiens
MLGRPAKFSKARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERD

SEQ ID NO: 62155 - protein, 263 aa, Homo sapiens
MARGPKKHLKRVAAPKHWMLDKLTGVFAPRPSTGPHKLRECLPLIVFLRNRLKYALTGDEVKKICMQHFLKIDGKVRVDITYPAGFIDVISIEKTGEHFRLVYNTKGCFAVHRITVEEAKYKLCKVRKITVGTKGIPHLVTHDARTIRYPDPLIKVNDTVQIDLGTGKITSFIKFDTGNVCMVIAGANLGRVGVITNRERHPGSCDVVHVKDANGNSFATRISNIFVIGNGNKPWISLPRGKGIRLTIAEERDKRLAAKQSSG

SEQ ID NO: 62156 - protein, 204 aa, Homo sapiens [sequence omitted]

SEQ ID NO: 62157 - protein, 204 aa, Homo sapiens [sequence omitted]

SEQ ID NO: 62158 - protein, 218 aa, Homo sapiens
MATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLNKEGKKPRTKAPKIQRLVTPRVLQHKRRRIALKKQRTKKNKEEAAEYAKLLAKRMKEAKEKRQEQIAKRRRLSSLRASTSKSESSQK

SEQ ID NO: 62159 - protein, 91 aa, Homo sapiens
MKLNISFPATGCQKLIEVDDERKLRTFYEKRMATEVAADALGEEWKVKVDKLLQVFKSETVNAIGNWYLEWGSDSGFWLLTFGKLLPNATL

SEQ ID NO: 62160 - protein, 218 aa, Homo sapiens; identical to SEQ ID NO: 62158

SEQ ID NO: 62161 - protein, 249 aa, Homo sapiens
MKLNISFPATGCQKLIEVDDERKLRTFYEKRMATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLNKEGKKPRTKAPKIQRLVTPRVLQHKRRRIALKKQRTKKNKEEAAEYAKLLAKRMKEAKEKRQEQIAKRRRLSSLRASTSKSESSQK

SEQ ID NO: 62162 - protein, 194 aa, Homo sapiens [sequence omitted]

SEQ ID NO: 62163 - protein, 194 aa, Homo sapiens [sequence omitted]

SEQ ID NO: 62164 - protein, 194 aa, Homo sapiens [sequence omitted]

SEQ ID NO: 62165 - protein, 188 aa, Homo sapiens
MGISRDNWHKRRKTGGKRKPYHKKRKYELGRPAANTKIGPRRIHTVRVRGGCTRKTRIIDVVYNASNNELVRTKTLVKNCIVLIDSTPYRQWYESHYALPLGRKKGAKLTPEEEEILNKKRSKKIQKKYDERKKNAKISSLLEEQFQQGKLLACIASRPGQCGRADGYVLEGKELEFYLRKIKARKGK

SEQ ID NO: 62166 - protein, 208 aa, Homo sapiens [sequence omitted]

SEQ ID NO: 62167 - protein, 194 aa, Homo sapiens [sequence omitted]

SEQ ID NO: 62168 - protein, 194 aa, Homo sapiens [sequence omitted]

SEQ ID NO: 62169 - protein, 194 aa, Homo sapiens [sequence omitted]

SEQ ID NO: 62170 - protein, 139 aa, Homo sapiens
MPVARSWVCRKTYVTPRRPFEKSRLDQELKLIGEYGLRNKREVWRVKFTLAKIRKAARELLTLDEKDPRRLFEGNALLRRLVRIGVLDEGKMKLDYILGLKIEDFLERRLQTQVFKLGLAKSIHHARVLIRQRHISPRR

SEQ ID NO: 62171 - protein, 139 aa, Homo sapiens; identical to SEQ ID NO: 62170

SEQ ID NO: 62172 - protein, 156 aa, Homo sapiens
MPVARSWVCRKTYVTPRRPFEKSRLDQELKLIGEYGLRNKREVWRVKFTLAKIRKAARELLTLDEKDPRRLFEGNALLRRLVRIGVLDEGKMKLDYILGLKIEDFLERRLQTQVFKLGLAKSIHHARVLIRQRHIRYHLGWAPESSSTCPSDGCPH

SEQ ID NO: 62173 - protein, 139 aa, Homo sapiens; identical to SEQ ID NO: 62170

SEQ ID NO: 62174 - protein, 317 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 62175 - protein, 255 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 62176 - protein, 317 aa, Homo sapiens; identical to SEQ ID NO: 62174

SEQ ID NO: 62177 - protein, 317 aa, Homo sapiens; identical to SEQ ID NO: 62174

SEQ ID NO: 62178 - protein, 114 aa, Homo sapiens
MASVSELACIYSALILHDDEVTVTEDKINALIKAAGVNVEPFWPGLFAKALANVNIGSLICNVGAGGPAPAAGAAPAGGPAPSTAAAPAEEKKVEAKKEESEESDDDMGFGLFD

SEQ ID NO: 62179 - protein, 89 aa, Homo sapiens
MASVSELACIYSALILHDDEVTVTALANVNIGSLICNVGAGGPAPAAGAAPAGGPAPSTAAAPAEEKKVEAKKEESEESDDDMGFGLFD

SEQ ID NO: 62180 - protein, 758 aa, Homo sapiens
MAPAMQPAEIQFAQRLASSEKGIRDRAVKKLRQYISVKTQRETGGFSQEELLKIWKGLFYCMWVQDEPLLQEELANTIAQLVHAVNNSAAQHLFIQTFWQTMNREWKGIDRLRLDKYYMLIRLVLRQSFEVLKRNGWEESRIKVFLDVLMKEVLCPESQSPNGVRFHFIDIYLDELSKVGGKELLADQNLKFIDPFCKIAAKTKDHTLVQTIARGVFEAIVDQSPFVPEETMEEQKTKVGDGDLSAEEIPENEVSLRRAVSKKKTALGKNHSRKDGLSDERGRDDCGTFEDTGPLLQFDYKAVADRLLEMTSRKNTPHFNRKRLSKLIKKFQDLSEGSSISQLSFAEDISADEDDQILSQGKHKKKGNKLLEKTNLEKEKGSRVFCVEEEDSESSLQKRRRKKKKKHHLQPENPGPGGAAPSLEQNRGREPEASGLKALKARVAEPGAEATSSTGEESGSEHPPAVPMHNKRKRPRKKSPRAHREMLESAVLPPEDMSQSGPSGSHPQGPRGSPTGGAQLLKRKRKLGVVPVNGSGLSTPAWPPLQQEGPPTGPAEGANSHTTLPQRRRLQKKKAGPGSLELCGLPSQKTASLKKRKKMRVMSNLVEHNGVLESEAGQPQALGSSGTCSSLKKQKLRAESDFVKFDTPFLPKPLFFRRAKSSTATHPPGPAVQLNKTPSSSKKVTFGLNRNMTAEFKKTDKSILVSPTGPSRVAFDPEQKPLHGVLKTPTSSPASSPLVAKKPLTTTPRRRPRAMDFF

SEQ ID NO: 62181 - protein, 259 aa, Homo sapiens
MPGANYRAGAGAGAGARRPRGARDREEDGGGLEPAAVARDLLRGTSNMSFEELLELQSQVGTKTYKQLVAGNSPKKQASRPPIQNACVADKHRPLEMSAKIRVPFLRQVVPISKKVARDPRFDDLSGEYNPEVFDKTYQFLNDIRAKEKELVKKQLKKHLSGEEHEKLQQLLQRMEQQEMAQQERKQQQELHLALKQERRAQAQQGHRPYFLKKSEQRQLALAEKFKELKRSKKLENFLSRKRRRNAGKDRRHLPLSKE

SEQ ID NO: 62182 - protein, 1410 aa, Homo sapiens
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAKKVEGAQNQGKKAEGAQNQGKKGEGAQNQGKKAEGAQNQGKKAEGAQNQGKKAEGAQNQGKKAEGAQNQGKKAEGAQNQGKKSEGAQNQGKKVEGAQNQGKKAEGAQNQGKKAEGAQNQGKKAEGAQNQGKKAEGAQNQGKKAEGAQNQGKKAEGAQNQGKKAEGAQNQGKKVEGAQNQGKKAEGAQNQGKKAEGAQNQGKKAEGAQNQGQKGEGAQNQGKKTEGAQGKKAERSPNQGKKGEGAPIQGKKADSVANQGTKVEGITNQGKKAEGSPSEGKKAEGSPNQGKKADAAANQGKKTESASVQGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLLSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKAEDGSSSKEGTSV

SEQ ID NO: 62183 - protein, 977 aa, Homo sapiens
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEGRNTDVAQSPEAPKQEAPAKKKSGSKKKGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLLSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKAEDGSSSKEGTSV

SEQ ID NO: 62184 - protein, 977 aa, Homo sapiens; identical to SEQ ID NO: 62183

SEQ ID NO: 62185 - protein, 1410 aa, Homo sapiens; identical to SEQ ID NO: 62182

SEQ ID NO: 62186 - protein, 300 aa, Homo sapiens
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAK

SEQ ID NO: 62187 - protein, 751 aa, Homo sapiens
MVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLLSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKAEDGSSSKEGTSV

SEQ ID NO: 62188 - protein, 220 aa, Homo sapiens
MASGCKIGPSILNSDLANLGAECLRMLDSGADYLHLDVMDGYMHMMVSKPEQWVKPMAVAGANQYTFHLEATENPGALIKDIRENGMKSCSVTQAEVQWHSQGPLQVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 62189 - protein, 228 aa, Homo sapiens
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 62190 - protein, 178 aa, Homo sapiens
MHMMVSKPEQWVKPMAVAGANQYTFHLEATENPGALIKDIRENGMKSCSVTQAEVQWHSQGPLQVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 62191 - protein, 178 aa, Homo sapiens; identical to SEQ ID NO: 62190

SEQ ID NO: 62192 - protein, 94 aa, Homo sapiens
MHMMVSKPEQWVKPMAVAGANQYTFHLEATENPGALIKDIRENGMKSCSVTQAEVQWHSQGPLQVGLAIKPGTSVEYLAPWANQIDMALVMTVE

SEQ ID NO: 62193 - protein, 178 aa, Homo sapiens; identical to SEQ ID NO: 62190

SEQ ID NO: 62194 - protein, 199 aa, Homo sapiens
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKAGANMIVSGSAIMRSEDPRSVINLLRNVCSEAAQKRSLDR

SEQ ID NO: 62195 - protein, 1052 aa, Homo sapiens
MREAAERRQQLQLEHDQALAVLSAKQQEIDLLQKSKVRELEEKCRTQSEQFNLLSRDLEKFRQHAGKIDLLGGSAVAPLDISTAPSKPFPQFMNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQPHCCHGDEYHTESSRGSDLSDIMEEDEEELYSEMQLEDGGRRRPSGTSHNALKILGNPASAGRVDHMGRRFPRGSAGPQRSRPVTVPSIDDYGRDRLSPDFYEESETDPGAEELPARIFVALFDYDPLTMSPNPDAAEEELPFKEGQIIKVYGDKDADGFYRGETCARLGLIPCNMVSEIQADDEEMMDQLLRQGFLPLNTPVEKIERSRRSGRRHSVSTRRMVALYDYDPRESSPNVDVEAELTFCTGDIITVFGEIDEDGFYYGELNGQKGLVPSNFLEEVPDDVEVYLSDAPSHYSQDTPMRSKAKRKKSVHFTP

SEQ ID NO: 62196 - protein, 645 aa, Homo sapiens
MNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQMAS

SEQ ID NO: 62197 - protein, 645 aa, Homo sapiens
MNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQMVS

SEQ ID NO: 62198 - protein, 1545 aa, Homo sapiens
MQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQAENKQLRRAGCPYQADEKVKRLKVKRAELTGLARRLADRARKLQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGAQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELEDGRRGLVPSNFVEQIPDSYIPGCLPAKSPDLGPSQLPAGQDEALEEDSLLSGKAQGVVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRARVEVRLPRDLLQVYWGTMSSTVTFDTLLAGPPYPPLDVLVERHASPGVLVVSWLPVTIDSAGSSNGVQVTGYAVYADGLKVCEVADATAGSTLLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCSQHMGTSKSPAPGFIHLRTECGPRKEPCQEKAALERVLRQKQDAQGFTPPQLGASQQYASDFHNVLKEEQEALCLDLWGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGNLPSVAHLEDFQGLTIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 62199 - protein, 1639 aa, Homo sapiens
MAKDSPSPLGASPKKPGCSSPAAAVLENQRRELEKLRAELEAERAGWRAERRRFAARERQLREEAERERRQLADRLRSKWEAQRSRELRQLQEEMQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQAENKQLRRAGCPYQADEKVKRLKVKRAELTGLARRLADRARKLQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGAQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELEDGRRGLVPSNFVEQIPDSYIPGCLPAKSPDLGPSQLPAGQDEALEEDSLLSGKAQGVVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRARVEVRLPRDLLQVYWGTMSSTVTFDTLLAGPPYPPLDVLVERHASPGVLVVSWLPVTIDSAGSSNGVQVTGYAVYADGLKVCEVADATAGSTLLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCSQHMGTSKSPAPGFIHLRTECGPRKEPCQEKAALERVLRQKQDAQGFTPPQLGASQQYASDFHNVLKEEQEALCLDLWGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGNLPSVAHLEDFQGLTIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 62200 - protein, 1545 aa, Homo sapiens
MQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQEENKQLRRAGCPYQADEKVKRLKVKRAELTGLARRLADRARELQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGTQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELDDGRRGLVPSNFVEQIPDSYIPGCLPAKSPDLGPSQLPAGQDEALEEDSLLSGKAQGMVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRVRVEVRLPWDLLQVYWGTMSSTVTFDTLLAGPPYPPLEVLVERHASPGVLVVSWLPVTIDSAGSSNGVQVTGYAVYADGLKVCEVADATAGSTVLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCYQHMGTSKSPAPGFIHLRTECGPRKEPCQEKAALERVLRQKQDAQGFTPPQLGASQQYASDFHNVLKEEQEALCLDLRGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGHLPSVAHLEDFQGLTIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 62201 - protein, 1639 aa, Homo sapiens
MAKDSPSPLGASPKKPGCSSPAAAVLENQRRELEKLRAELEAERAGWRAERRRFAARERQLREEAERERRQLADRLRSKWEAQRSRELRQLQEEMQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQEENKQLRRAGCPYQADEKVKRLKVKRAELTGLARRLADRARELQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGTQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELDDGRRGLVPSNFVEQIPDSYIPGCLPAKSPDLGPSQLPAGQDEALEEDSLLSGKAQGMVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRVRVEVRLPWDLLQVYWGTMSSTVTFDTLLAGPPYPPLEVLVERHASPGVLVVSWLPVTIDSAGSSNGVQVTGYAVYADGLKVCEVADATAGSTVLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCYQHMGTSKSPAPGFIHLRTECGPRKEPCQEKAALERVLRQKQDAQGFTPPQLGASQQYASDFHNVLKEEQEALCLDLRGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGHLPSVAHLEDFQGLTIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 62202 - protein, 1545 aa, Homo sapiens
MQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQEENKQLRRAGCPYQADEKVKRLKVKRAELTGLARRLADRARELQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGTQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELDDGRRGLVPSNFVEQIPDSYIPGCLPAKSPDLGPSQLPAGQDEALEEDSLLSGKAQGMVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRVRVEVRLPWDLLQVYWGTMSSTVTFDTLLAGPPYPPLDVLVERHASPGVLVVSWLPVTIDSAGSSNGVQVTGYAVYADGLKVCEVADATAGSTVLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCYQHMGTSKSPAPGFIHLRTECGPRKEPCQEKAALERVLRQKQDAQGFTPPQLGASQQYASDFHNVLKEEQEALCLDLRGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGHLPSVAHLEDFQGLIIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 62203 - protein, 1639 aa, Homo sapiens
MAKDSPSPLGASPKKPGCSSPAAAVLENQRRELEKLRAELEAERAGWRAERRRFAARERQLREEAERERRQLADRLRSKWEAQRSRELRQLQEEMQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQEENKQLRRAGCPYQADEKVKRLKVKRAELTGLARRLADRARELQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGTQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELDDGRRGLVPSNFVEQIPDSYIPGCLPAKSPDLGPSQLPAGQDEALEEDSLLSGKAQGMVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRVRVEVRLPWDLLQVYWGTMSSTVTFDTLLAGPPYPPLDVLVERHASPGVLVVSWLPVTIDSAGSSNGVQVTGYAVYADGLKVCEVADATAGSTVLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCYQHMGTSKSPAPGFIHLRTECGPRKEPCQEKAALERVLRQKQDAQGFTPPQLGASQQYASDFHNVLKEEQEALCLDLRGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGHLPSVAHLEDFQGLIIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 62204 - protein, 1133 aa, Homo sapiens
MPVQAPQWTDFLSCPICTQTFDETIRKPISLGCGHTVCKMCLNKLHRKACPFDQTTINTDIELLPVNSALLQLVGAQVPEQQPITLCSGVEDTKHYEEAKKCVEELALYLKPLSSARGVGLNSTTQSVLSRPMQRKLVTLVHCQLVEEEGRIRAMRAARSLGERTVTELILQHQNPQQLSSNLWAAVRARGCQFLGPAMQEEALKLVLLALEDGSALSRKVLVLFVVQRLEPRFPQASKTSIGHVVQLLYRASCFKVTKRDEDSSLMQLKEEFRTYEALRREHDSQIVQIAMEAGLRIAPDQWSSLLYGDQSHKSHMQSIIDKLQTPASFAQSVQELTIALQRTGDPANLNRLRPHLELLANIDPSPDAPPPTWEQLENGLVAVRTVVHGLVDYIQNHSKKGADQQQPPQHSKYKTYMCRDMKQRGGCPRGASCTFAHSQEELEKFRKMNKRLVPRRPLSASLGQLNEVGLPSAAILPDEGAVDLPSRKPPALPNGIVSTGNTVTQLIPRGTDPSYDSSLKPGKIDHLSSSAPGSPPDLLESVPKSISALPVNPHSIPPRGPADLPPMPVTKPLQMVPRGSQLYPAQQTDVYYQDPRGAAPPFEPAPYQQGMYYTPPPQCVSRFVRPPPSAPEPAPPYLDHYPPYLQERVVNSQYGTQPQQYPPIYPSHYDGRRVYPAPSYTREEIFRESPIPIEIPPAAVPSYVPESRERYQQIESYYPVAPHPTQIRPSYLREPPYSRLPPPPQPHPSLDELHRRRKEIMAQLEERKVISPPPFAPSPTLPPTFHPEEFLDEDLKVAGKYKGNDYSQYSPWSCDTIGSYIGTKDAKPKDVVAAGSVEMMNVESKGMRDQRLDLQRRAAETSDDDLIPFGDRPTVSRFGAISRTSKTIYQGAGPMQAMAPQGAPTKSINISDYSPYGTHGGWGASPYSPHQNIPSQGHFSERERISMSEVASHGKPLPSAEREQLRLELQQLNHQISQQTQLRGLEAVSNRLVLQREANTLAGQSQPPPPPPPKWPGMISSEQLSLELHQVEREIGKRTRELSMENQCSLDMKSKLNTSKQAENGQPEPQNKVPAEDLTLTFSDVPNGSALTQENISLLSNKTSSLNLSEDPEGGGDNNDSQRSGVTPSSAP

SEQ ID NO: 62205 - protein, 1125 aa, Homo sapiens
MPVQAPQWTDFLSCPICTQTFDETIRKPISLGCGHTVCKMCLNKLHRKACPFDQTTINTDIELLPVNSALLQLVGAQVPEQQPITLCSGVEDTKHYEEAKKCVEELALYLKPLSSARGVGLNSTTQSVLSRPMQRKLVTLVHCQLVEEEGRIRAMRAARSLGERTVTELILQHQNPQQLSSNLWAAVRARGCQFLGPAMQEEALKLVLLALEDGSALSRKVLVLFVVQRLEPRFPQASKTSIGHVVQLLYRASCFKVTKRDEDSSLMQLKEEFRTYEALRREHDSQIVQIAMEAGLRIAPDQWSSLLYGDQSHKSHMQSIIDKLQTPASFAQSVQELTIALQRTGDPANLNRLRPHLELLANIDPSPDAPPPTWEQLENGLVAVRTVVHGLVDYIQNHSKKGADQQQPPQHSKYKTYMCRDMKQRGGCPRGASCTFAHSQEELEKFRKMNKRLVPRRPLSASLGQLNEVGLPSAAILPDEGAVDLPSRKPPALPNGIVSTGNTVTQLIPRGTDPSYDSSLKPGKIDHLSSSAPGSPPDLLESVPKSISALPVNPHSIPPRGPADLPPMPVTKPLQMVPRGSQLYPAQQTDVYYQDPRGAAPPFEPAPYQQGMYYTPPPQCVSRFVRPPPSAPEPAPPYLDHYPPYLQERVVNSQYGTQPQQYPPIYPSHYDGRRVYPAPSYTREEIFRESPIPIEIPPAAVPSYVPESRERYQQIESYYPVAPHPTQIRPSYLREPPYSRLPPPPQPHPSLDELHRRRKEIMAQLEERKVISPPPFAPSPTLPPTFHPEEFLDEDLKVAGKYKGNDYSQYSPWSCDTIGSYIGTKDAKPKDVVAAGSVEMMNVESKGMRDQRLDLQRRAAETSDDDLIPFGDRPTVSRFGAISRTSKTIYQGAGPMQAMAPQGAPTKSINISDYSPYGTHGGWGASPYSPHQNIPSQGHFSERERISMSEVASHGKPLPSAEREQLRLELQQLNHQISQQTQLRGLEREANTLAGQSQPPPPPPPKWPGMISSEQLSLELHQVEREIGKRTRELSMENQCSLDMKSKLNTSKQAENGQPEPQNKVPAEDLTLTFSSDVPNGSALTQENISLLSNKTSSLNLSEDPEGGGDNNDSQRSGVTPSSAP

SEQ ID NO: 62206 - protein, 1133 aa, Homo sapiens; identical to SEQ ID NO: 62204

SEQ ID NO: 62207 - protein, 327 aa, Homo sapiens
MWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQSIDSEDSFVPGRRASLSDLTDLEDIEGLTVRQLKEILARNFVNYKGCCEKWELMERVTRLYKDQKGLQHLGGAVPSGLEENLCKICMDSPIDCVLLECGHMVTCTKCGKRMNECPICRQYVIRAVHVFRS

SEQ ID NO: 62208 - protein, 363 aa, Homo sapiens
MWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQANGHVSQDQEEPVYLESVARVPAEDETQSIDSEDSFVPGRRASLSDLTDLEDIEGLTVRQLKEILARNFVNYKGCCEKWELMERVTRLYKDQKGLQHLVSGAEDQNGGAVPSGLEENLCKICMDSPIDCVLLECGHMVTCTKCGKRMNECPICRQYVIRAVHVFRS

SEQ ID NO: 62209 - protein, 355 aa, Homo sapiens
MWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQANGHVSQDQEEPVYLESVARVPAEDETQSIDSEDSFVPGRRASLSDLTDLEDIEGLTVRQLKEILARNFVNYKGCCEKWELMERVTRLYKDQKGLQHLGGAVPSGLEENLCKICMDSPIDCVLLECGHMVTCTKCGKRMNECPICRQYVIRAVHVFRS

SEQ ID NO: 62210 - protein, 363 aa, Homo sapiens; identical to SEQ ID NO: 62208

SEQ ID NO: 62211 - protein, 271 aa, Homo sapiens
MWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQANGHVSQDQEEPVYLESVARVPAEDETQSIDSEDSFVPGRRASLSDLTDLEDIEGLTVRQLKEILARNFVNYKG

SEQ ID NO: 62212 - protein, 133 aa, Homo sapiens
MWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLV

SEQ ID NO: 62213 - protein, 189 aa, Homo sapiens
MWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPP

SEQ ID NO: 62214 - protein, 45 aa, Homo sapiens
MWATCCNWFCLDGQPEEVPPPQGARMQAYSNPGYSSFPSPTGLEP

SEQ ID NO: 62215 - protein, 707 aa, Homo sapiens
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEKRFKLDHSNGHRWQIFQDWLGTDQDNLDLANVNLMLELLVQKKKQLEAESHAAQLQILMEFLKVARRNKREEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 62216 - protein, 506 aa, Homo sapiens
MEFLKVARRNKREQLEQIQKELSVLEEDIKRVEEMSGLYSPVSEDSTVPQFEAPSPSHSSIIDSTEYSQPPGFSGSSQAGVQWRYLGSLQPPPPRYKRFSCLTLPSSWDYRRLPPHLTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLALL

SEQ ID NO: 62217 - protein, 731 aa, Homo sapiens
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEKRFKLDHSVSSTNGHRWQIFQDWLGTDQDNLDLANVNLMLELLVQKKKQLEAESHAAQLQILMEFLKVARRNKREQLEQIQKELSVLEEDIKRVEEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 62218 - protein, 257 aa, Homo sapiens
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEKRFKLDHSVSSTNGHRWQIFQDWLGTDQDNLDLANVNLMLELLVQKNKKKKKKKK

SEQ ID NO: 62219 - protein, 774 aa, Homo sapiens
MAHEAMEYDVQVQLNHAEQQPAPAGMASSQGGPALLQPVPADVVSSQGVPSILQPAPAEVISSQATPPLLQPAPQLSVDLTEVEVLGEDTVENINPRTSEQHRQGSDGNHTIPASSLHSMTNFISGLQRLHGMLEFLRPSSSNHSVGPMRTRRRVSASRRARAGGSQRTDSARLRAPLDAYFQVSRTQPDLPATTYDSETRNPVSEELQVSSSSDSDSDSSAEYGGVVDQAEESGAVILEEQLAGVSAEQEVTCIDGGKTLPKQPSPQKSEPLLPSASMDEEEGDTCTICLEQWTNAGDHRLSALRCGHLFGYRCISTWLKGQVRKCPQCNKKARHSDIVVLYARTLRALDTSEQERMKSSLLKEQMLRKQAELESAQCRLQLQVLTDKCTRLQRRVQDLQKLTSHQSQNLQQPRGSQAWVLSCSPSSQGQHKHKYHFQKTFTVSQAGNCRIMAYCDALSCLVISQPSPQASFLPGFGVKMLSTANMKSSQYIPMHGKQIRGLAFSSYLRGLLLSASLDNTIKLTSLETNTVVQTYNAGRPVWSCCWCLDEANYIYAGLANGSILVYDVRNTSSHVQELVAQKARCPLVSLSYMPRAASAAFPYGGVLAGTLEDASFWEQKMDFSHWPHVLPLEPGGCIDFQTENSSRHCLVTYRPDKNHTTIRSVLMEMSYRLDDTGNPICSCQPVHTFFGGPTCKLLTKNAIFQSPENDGNILVCTGDEAANSALLWDAASGSLLQDLQTDQPVLDICPFEVNRNSYLATLTEKMVHIYKWE

SEQ ID NO: 62220 - protein, 263 aa, Homo sapiens
MAHEAMEYDVQVQLNHAEQQPAPAGMASSQGGPALLQPVPADVVSSQGVPSILQPAPAEVISSQATPPLLQPAPQLSVDLTEVEVLGEDTVENINPRTSEQHRQGSDGNHTIPASSLHSMPLEPGGCIDFQTENSSRHCLVTYRPDKNHTTIRSVLMEMSYRLDDTGNPICSCQPVHTFFGGPTCKLLTKNAIFQSPENDGNILVCTGDEAANSALLWDAASGSLLQDLQTDQPVLDICPFEVNRNSYLATLTEKMVHIYKWE

SEQ ID NO: 62221 - protein, 685 aa, Homo sapiens [sequence omitted]

SEQ ID NO: 62222 - protein, 685 aa, Homo sapiens [sequence omitted]

SEQ ID NO: 62223 - protein, 685 aa, Homo sapiens [sequence omitted]

SEQ ID NO: 62224 - protein, 329 aa, Homo sapiens
MQLEVDKMGTKLGELLVSRITVEEGEESSRSSTAVRRHPTITLDLQVRRIRPGENRDRDSIANRTRSRVGLAENTVTIESNSGGFRRTISRLERSGIRTYVSTITVPLRRISENELVEPSSVALRSILRQIMTGFGELSSLMEADSESELQRNGQHLPDMHSELSNLGTDNNRSQHREGSSQDRQAQGDSTEMHGENETTQPHTRNSDSRGGRQLRNPNNLVETGTLPILRLAHFFLLNESDDDDRIRGLTKEQIDNLSTRHYEHNSIDSELGKICSVCISDYVTGNKLRQLPCMHEFHIHCIDRWLSENCTCPICRQPVLGSNIANNG

SEQ ID NO: 62225 - protein, 406 aa, Homo sapiens
MTTPANAQNASKTWELSLYELHRTPQEAIMDGTEIAVSPRSLHSELMCPICLDMLKNTMTTKECLHRFCSDCIVTALRSGNKECPTCRKKLVSKRSLRPDPNFDALISKIYPSREEYEAHQDRVLIRLSRLHNQQALSSSIEEGLRMQAMHRAQRVRRPIPGSDQTTTMSGGEGEPGEGEGDGEDVSSDSAPDSAPGPAPKRPRGGGAGGSSVGTGGGGTGGVGGGAGSEDSGDRGGTLGGGTLGPPSPPGAPSPPEPGGEIELVFRPHPLLVEKGEYCQTRYVKTTGNATVDHLSKYLALRIALERRQQQEAGEPGGPGGGASDTGGPDGCGGEGGGAGGGDGPEEPALPSLEGVSEKQYTIYIAPGGGAFTTLNGSLTLELVNEKFWKVSRPLELCYAPTKDPK

SEQ ID NO: 62226 - protein, 406 aa, Homo sapiens; identical to SEQ ID NO: 62225

SEQ ID NO: 62227 - protein, 406 aa, Homo sapiens; identical to SEQ ID NO: 62225

SEQ ID NO: 62228 - protein, 406 aa, Homo sapiens; identical to SEQ ID NO: 62225

SEQ ID NO: 62229 - protein, 406 aa, Homo sapiens; identical to SEQ ID NO: 62225

SEQ ID NO: 62230 - protein, 406 aa, Homo sapiens; identical to SEQ ID NO: 62225

SEQ ID NO: 62231 - protein, 154 aa, Homo sapiens
MGNCLKSPTSDDISLLHESQSDRASFGEGTEPDQEPPPPYQEQVPVPVYHPTPSQTRLATQLTEEEQIRIAQRIGLIQHLPKGVYDPGRDGSEKKIRECVICMMDFVYGDPIRFLPCMHIYHLDCIDDWLMRSFTCPSCMEPVDAALLSSYETN

SEQ ID NO: 62232 - protein, 631 aa, Homo sapiens
MPRPALSVTSFCHRLGKRERKQSFMGNSGNSWSHTPFPKLELGLGPQPMAPRELPTCSICLERLRDPISLDCGHDFCIRCFSTHRLPGCEPPCCPECRKICKQKRGLRSLGEKMKLLPQRPLPPALQETCPVRAEPLLLVRINASGGLILRMGAINRCLKHPLARDTPVCLLAVLGEQHSGKSFLLNHLLQGLPGLESGEGGRPRGGEASLQGCRWGANGLARGIWMWSHPFLLGKEGKKVAVFLVDTGDAMSPELSRETRIKLCALTTMLSSYQILSTSQELKDTDLDYLEMFVHVAEVMGKHYGMVPIQHLDLLVRDSSHPNKAGQGHVGNIFQRLSGRYPKVQELLQGKRARCCLLPAPGRRRMNQGHASPGDTDDDFRHLLGAYVSDVLSAAPQHAKSRCQGYWNEGRAVARGDRRLLTGQQLAQEIKNLSGWMGRTGPGFTSPDEMAAQLHDLRKVEAAKREFEEYVRQQDVATKRIFSALRVLPDTMRNLLSTQKDAILARHGVALLCKGRDQTLEALEAELQATAKAFMDSYTMRFCGHLAAVGGAVGAGLMGLAGGVVGAGMAAAALAAEAGMVAAGAAVGATGAAVVGGGVGAGLAATVGCMEKEEDERLLEGDREPLLQEE

SEQ ID NO: 62233 - protein, 228 aa, Homo sapiens
MAAQQRDCGGAAQLAGPAAEADPLGRFTCPVCLEVYEKPVQVPCGHVFCSACLQECLKPKKPVCGVCRSALAPGVRAVELERQIESTETSCHGCRKNFFLSKIRSHVATCSKYQNYIMEGVKATIKDASLQPRNVPNRYTFPCPYCPEKNFDQEGLVEHCKLFHSTDTKSVVCPICASMPWGDPNYRSANFREHIQRRHRFSYDTFVDYDVDEEDMMNQVLQRSIIDQ

SEQ ID NO: 62234 - protein, 191 aa, Homo sapiens
MAAQQRDCGGAAQLAGPAAEADPLGRFTCPVCLEVYEKPVQVPCGHVFCSACLQECLKPKKPVCGVCRSALAPGVRAVELERQIESTETSCHGCRKNFFLSKIRSHVATCSKYQNYIMEGVKATIKDASLQPRNVPNRYTFPCPYCPEKNFDQEGLVEHCKLFHSTDTKSVTSEQSPCLLSVSCYRASITY

SEQ ID NO: 62235 - protein, 428 aa, Homo sapiens
MGPPPGAGVSCRGGCGFSRLLAWCFLLALSPQAPGSRGAEAVWTAYLNVSWRVPHTGVNRTVWELSEEGVYGQDSPLEPVAGVLVPPDGPGALNACNPHTNFTVPTVWGSTVQVSWLALIQRGGGCTFADKIHLAYERGASGAVIFNFPGTRNEVIPMSHPGAVDIVAIMIGNLKGTKILQSIQRGIQVTMVIEVGKKHGPWVNHYSIFFVSVSFFIITAATVGYFIFYSARRLRNARAQSRKQRQLKADAKKAIGRLQLRTLKQGDKEIGPDGDSCAVCIELYKPNDLVRILTCNHIFHKTCVDPWLLEHRTCPMCKCDILKALGIEVDVEDGSVSLQVPVSNEISNSASSHEEDNRSETASSGYASVQGTDEPPLEEHVQSTNESLQLVNHEANSVAVDVIPHVDNPTFEEDETPNQETAVREIKS

SEQ ID NO: 62236 - protein, 402 aa, Homo sapiens
MNQENRSSFFWLLVIFTFLLKITASFSMSAYVTVTYYNETSNYTAIETCECGVYGLASPVANAMGVVGIPKNNNYQACDHNTEFSNTKKPWIALIERGNCTFSEKIQTAGRRNADAVVIYNAPETGNQTIQMANFGAVDIVAIMIGNLKGTKILQSIQRGIQVTMVIEVGKKHGPWVNHYSIFFVSVSFFIITAATVGYFIFYSARRLRNARAQSRKQRQLKADAKKAIGRLQLRTLKQGDKEIGPDGDSCAVCIELYKPNDLVRILTCNHIFHKTCVDPWLLEHRTCPMCKCDILKALGIEVDVEDGSVSLQVPVSNEISNSASSHEEDNRSETASSGYASVQGTDEPPLEEHVQSTNESLQLVNHEANSVAVDVIPHVDNPTFEEDETPNQETAVREIKS

SEQ ID NO: 62237 - protein, 249 aa, Homo sapiens
MSAYVTVTYYNETSNYTAIETCECGVYGLASPVANAMGVVGIPKNNNYQACDHNTEFSNTKKPWIALIERGNCTFSEKIQTAGRRNADAVVIYNAPETGNQTIQMANFGAVDIVAIMIGNLKGTKILQSIQRGIQVTMVIEVGKKHGPWVNHYSIFFVSVSFFIITAATVGYFIFYSARRLRNARAQSRKQRQLKADAKKAIGRLQLRTLKQGDKEIGPDGDSCAVCIELYKPNDLVRILTCNHIFHKT

SEQ ID NO: 62238 - protein, 210 aa, Homo sapiens
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRVAVEKSITEVAQELTELVEHLVDIVRSLQNQRPLSESGPDNELSILGKENSWKPRLPPHAHCLTRATLHSGELLGLLSGPSIQPLT

SEQ ID NO: 62239 - protein, 432 aa, Homo sapiens
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRVAVEKSITEVAQELTELVEHLVDIVRSLQNQRPLSESGPDNELSILGKAFSSGVDLSMASPKLVTSDTAAGKIRDILHDLEEIQEKLQESVTWKEAPEAQMQGELLEAPSSSSCPLPDQSHPALRRASRFAQWAIHPTFNLKSLSCSLEVSKDSRTVTVSHRPQPYRWSCERFSTSQVLCSQALSSGKHYWEVDTRNCSHWAVGVASWEMSRDQVLGRTMDSCCVEWKGTSQLSAWHMVKETVLGSDRPGVVGIWLNLEEGKLAFYSVDNQEKLLYECTISASSPLYPAFWLYGLHPGNYLIIKQVKV

SEQ ID NO: 62240 - protein, 84 aa, Homo sapiens
  MOD_RES (1)..(1): Any amino acid
XKEAPEAQMQGSLLPRLECSGTITAASISQAQENSWKPRLPPHAHCLTRATLHSGELLGLLSVPPRGELIAKAKQVETLDPRAL

SEQ ID NO: 62241 - protein, 96 aa, Homo sapiens
AQQPHLRKNTLLQDLADKYRRAAREIQAGSDPAHCPCPGSSSLSSAAARPRRRPELQRENSWKPRLPPHAHCLTRATLHSGELLGLLSGPSIQPLT

SEQ ID NO: 62242 - protein, 286 aa, Homo sapiens
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRVAVEKSITEVAQELTELVEHLVDIVRSLQNQRPLSESGPDNELSILGKAFSSGVDLSMASPKLVTSDTAAGKIRDILHDLEEIQEKLQESVTWKEAPEAQMQGSLLPRLECSGTITAASISQAQENSWKPRLPPHAHCLTRATLHSGELLGLLSGPSIQPLT

SEQ ID NO: 62243 - protein, 251 aa, Homo sapiens
MASPKLVTSDTAAGKIRDILHDLEEIQEKLQESVTWKEAPEAQMQGELLEAPSSSSCPLPDQSHPALRRASRFAQWAIHPTFNLKSLSCSLEVSKDSRTVTVSHRPQPYRWSCERFSTSQVLCSQALSSGKHYWEVDTRNCSHWAVGVASWEMSRDQVLGRTMDSCCVEWKGTSQLSAWHMVKETVLGSDRPGVVGIWLNLEEGKLAFYSVDNQEKLLYECTISASSPLYPAFWLYGLHPGNYLIIKQVKV

SEQ ID NO: 62244 - protein, 664 aa, Homo sapiens
MAAVGPPQQQVRMAHQQVWAALEVALRVPCLYIIDAIFNSYPDSSQSRFCIVLQIFLRLFGVFASSIVLILSQRSLFKFYTYSSAFLLAATSVLVNYYASLHIDFYGAYNTSAFGIELLPRKGPSLWMALIVLQLTFGIGYVTLLQIHSIYSQLIILDLLVPVIGLITELPLHIRETLLFTSSLILTLNTVFVLAVKLKWFYYSTRYVYLLVRHMYRIYGLQLLMEDTWKRIRFPDILRVFWLTRVTAQATVLMYILRMANETDSFFISWDDFWDLICNLIISGCDSTLTVLGMSAVISSVAHYLGLGILAFIGSTEEDDRRLGFVAPVLFFILALQTGLSGLRPEERLIRLSRNMCLLLTAVLHFIHGMTDPVLMSLSASHVSSFRRHFPVLFVSACLFILPVLLSYVLWHHYALNTWLFAVTAFCVELCLKVIVSLTVYTLFMIDGYYNVLWEKLDDYVYYVRSTGSIIEFIFGVVMFGNGAYTMMFESGSKIRAFMMCLHAYFNIYLQAKNGWKTFMNRRTAVKKINSLPEIKGSRLQEINDVCAICYHEFTTSARITPCNHYFHALCLRKWLYIQDTCPMCHQKVYIEDDIKDNSNVSNNNGFIPPNETPEEAVREAAAESDRELNEDDSTDCDDDVQRERNGVIQHTGAAAEEFNDDTD

SEQ ID NO: 62245 - protein, 474 aa, Homo sapiens
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGGAAGSDVDQEEIVDERAVQDVESLSNLIQEILDFDQAQQIKCFNSKLFLCSICFCEKLGSECMYFLECRHVYCKACLKDYFEIQIRDGQVQCLNCPEPKCPSVATPGQVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 62246 - protein, 474 aa, Homo sapiens; identical to SEQ ID NO: 62245

SEQ ID NO: 62247 - protein, 348 aa, Homo sapiens
MQFLKEETLAYLNIVSPFELKIGSQKKVQRRTAQASPNTELDFGGAAGSDVDQEEIVDERAVQDVESLSNLIQEILDFDQAQQIKCFNSKLFLCSICFCEKLGSECMYFLECRHVYCKACLKDYFEIQIRDGQVQCLNCPEPKCPSVATPGQVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 62248 - protein, 298 aa, Homo sapiens
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 62249 - protein, 474 aa, Homo sapiens; identical to SEQ ID NO: 62245

SEQ ID NO: 62250 - protein, 474 aa, Homo sapiens; identical to SEQ ID NO: 62245

SEQ ID NO: 62251 - protein, 15 aa, Homo sapiens
MSSEDREAQEDELLA

SEQ ID NO: 62252 - protein, 132 aa, Homo sapiens
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKE

SEQ ID NO: 62253 - protein, 171 aa, Homo sapiens
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGG

SEQ ID NO: 62254 - protein, 185 aa, Homo sapiens
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGGAAGSDVDQEEIVDE

SEQ ID NO: 62255 - protein, 61 aa, Homo sapiens
MSSEDREAQEDELLALASIYDGDEFRKAESVQGGETRIYLDLPQNFKIFVSGNSNECLQNS

SEQ ID NO: 62256 - protein, 278 aa, Homo sapiens
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGGAAGSDVDQEEIVDERAVQDVESLSNLIQEILDFDQAQQIKCFNSKLFLCSICFCEKLGSECMYFLECRHVYCKACLKDYFEIQIRDGQVQCLNCPEPKCPSVATPGQ

SEQ ID NO: 62257 - protein, 99 aa, Homo sapiens
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLS

SEQ ID NO: 62258 - protein, 171 aa, Homo sapiens
MSSEDREAQEDELLALASIYDGDEFRKAESVQGGETRIYLDLPQNFKIFVSEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 62259 - protein, 358 aa, Homo sapiens
MAGCGEIDHSINMLPTNRKANESCSNTAPSLTVPECAICLQTCVHPVSLPCKHVFCYLCVKGASWLGKRCALCRQEIPEDFLDKPTLLSPEELKAASRGNGEYAWYYEGRNGWWQYDERTSRELEDAFSKGKKNTEMLIAGFLYVADLENMVQYRRNEHGRRRKIKRDIIDIPKKGVAGLRLDCDANTVNLARESSADGADSVSAQSGASVQPLVSSVRPLTSVDGQLTSPATPSPDASTSLEDSFAHLQLSGDNTAERSHRGEGEEDHESPSSGRVPAPDTSIEETESDASSDSEDVSAVVAQHSLTQQRLLVSNANQTVPDRSDRSGTDRSVAGGGTVSVSVRSRRPDGQCTVTEV

SEQ ID NO: 62260 - protein, 358 aa, Homo sapiens; identical to SEQ ID NO: 62259

SEQ ID NO: 62261 - protein, 359 aa, Homo sapiens
MMAGCGEIDHSINMLPTNRKANESCSNTAPSLTVPECAICLQTCVHPVSLPCKHVFCYLCVKGASWLGKRCALCRQEIPEDFLDKPTLLSPEELKAASRGNGEYAWYYEGRNGWWQYDERTSRELEDAFSKGKKNTEMLIAGFLYVADLENMVQYRRNEHGRRRKIKRDIIDIPKKGVAGLRLDCDANTVNLARESSADGADSVSAQSGASVQPLVSSVRPLTSVDGQLTSPATPSPDASTSLEDSFAHLQLSGDNTAERSHRGEGEEDHESPSSGRVPAPDTSIEETESDASSDSEDVSAVVAQHSLTQQRLLVSNANQTVPDRSDRSGTDRSVAGGGTVSVSVRSRRPDGQCTVTEV

SEQ ID NO: 62262 - protein, 571 aa, Homo sapiens
MALPKDAIPSLSECQCGICMEILVEPVTLPCNHTLCKPCFQSTVEKASLCCPFCRRRVSSWTRYHTRRNSLVNVELWTIIQKHYPRECKLRASGQESEEVADDYQPVRLLSKPGELRREYEEEISKVAAERRASEEEENKASEEYIQRLLAEEEEEEKRQAEKRRRAMEEQLKSDEELARKLSIDINNFCEGSISASPLNSRKSDPVTPKSEKKSKNKQRNTGDIQKYLTPKSQFGSASHSEAVQEVRKDSVSKDIDSSDRKSPTGQDTEIEDMPTLSPQISLGVGEQGADSSIESPMPWLCACGAEWYHEGNVKTRPSNHGKELCVLSHERPKTRVPYSKETAVMPCGRTESGCAPTSGVTQTNGNNTGETENEESCLLISKEISKRKNQESSFEAVKDPCFSAKRRKVSPESSPDQEETEINFTQKLIDLEHLLFERHKQEEQDRLLALQLQKEVDKEQMVPNRQKGSPDEYHLRATSSPPDKVLNGQRKNPKDGNFKRQTHTKHPTPERGSRDKNRQVSLKMQLKQSVNRRKMPNSTRDHCKVSKSAHSLQPSISQKSVFQMFQRCTK

SEQ ID NO: 62263 - protein, 571 aa, Homo sapiens; identical to SEQ ID NO: 62262

SEQ ID NO: 62264 - protein, 1623 aa, Homo sapiens
MAAEASKTGPSRSSYQRMGRKSQPWGAAEIQCTRCGRRVSRSSGHHCELQCGHAFCELCLLMTEECTTIICPDCEVATAVNTRQRYYPMAGYIKEDSIMEKLQPKTIKNCSQDFKKTADQLTTGLERSASTDKTLLNSSAVMLDTNTAEEIDEALNTAHHSFEQLSIAGKALEHMQKQTIEERERVIEVVEKQFDQLLAFFDSRKKNLCEEFARTTDDYLSNLIKAKSYIEEKKNNLNAAMNIARALQLSPSLRTYCDLNQIIRTLQLTSDSELAQVSSPQLRNPPRLSVNCSEIICMFNNMGKIEFRDSTKCYPQENEIRQNVQKKYNNKKELSCYDTYPPLEKKKVDMSVLTSEAPPPPLQPETNDVHLEAKNFQPQKDVATASPKTIAVLPQMGSSPDVIIEEIIEDNVESSAELVFVSHVIDPCHFYIRKYSQIKDAKVLEKKVNEFCNRSSHLDPSDILELGARIFVSSIKNGMWCRGTITELIPIEGRNTRKPCSPTRLFVHEVALIQIFMVDFGNSEVLIVTGVVDTHVRPEHSAKQHIALNDLCLVLRKSEPYTEGLLKDIQPLAQPCSLKDIVPQNSNEGWEEEAKVEFLKMVNNKAVSMKVFREEDGVLIVDLQKPPPNKISSDMPVSLRDALVFMELAKFKSQSLRSHFEKNTTLHYHPPILPKEMTDVSVTVCHINSPGDFYLQLIEGLDILFLLKTIEEFYKSEDGENLEILCPVQDQACVAKFEDGIWYRAKVIGLPGHQEVEVKYVDFGNTAKITIKDVRKIKDEFLNAPEKAIKCKLAYIEPYKRTMQWSKEAKEKFEEKAQDKFMTCSVIKILEDNVLLVELFDSLGAPEMTTTSINDQLVKEGLASYEIGYILKDNSQKHIEVWDPSPEEIISNEVHNLNPVSAKSLPNENFQSLYNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKRQVDIHIMELPKNPWEKLSIHLYFDGMSLSYFMAYYKYCTSEHTEEMLKEKPRSDHDKKYEEEQWEIRFEELLSAETDTPLLPPYLSSSLPSPGELYAVQVKHVVSPNEVYICLDSIETSNQSNQHSDTDDSGVSGESESESLDEALQRVNKKVEALPPLTDFRTEMPCLAEYDDGLWYRAKIVAIKEFNPLSILVQFVDYGSTAKLTLNRLCQIPSHLMRYPARAIKVLLAGFKPPLRDLGETRIPYCPKWSMEALWAMIDCLQGKQLYAVSMAPAPEQIVTLYDDEQHPVHMPLVEMGLADKDE

SEQ ID NO: 62265 - protein, 449 aa, Homo sapiens
MAAEASKTGPSRSSYQRMGRKSQPWGAAEIQCTRCGRRVSRSSGHHCELQCGHAFCELCLLMTEECTTIICPDCEVATAVNTRQRYYPMAGYIKEDSIMEKLQPKTIKNCSQDFKKTADQLTTGLERSASTDKTLLNSSAVMLDTNTAEEIDEALNTAHHSFEQLSIAGKALEHMQKQTIEERERVIEVVEKQFDQLLAFFDSRKKNLCEEFARTTDDYLSNLIKAKSYIEEKKNNLNAAMNIARALQLSPSLRTYCDLNQIIRTLQLTSDSELAQVSSPQLRNPPRLSVNCSEIICMFNNMGKIEFRDSTKCYPQENEIRQNVQKKYNNKKELSCYDTYPPLEKKKVDMSVLTSEAPPPPLQPETNDVHLEAKNFQPQKDVATASPKTIAVLPQMGSSPDVIIEEIIEDNVETCGTDDLGETPRYPKKPLQKNSSVPFGSKADTVTTV

SEQ ID NO: 62266 - protein, 1581 aa, Homo sapiens
MAAEASKTGPSRSSYQRMGRKSQPWGAAEIQCTRCGRRVSRSSGHHCELQCGHAFCELCLLMTEECTTIICPDCEVATAVNTRQRYYPMAGYIKEDSIMEKLQPKTIKNCSQDFKKTADQLTTGLERSASTDKTLLNSSAVMLDTNTAEEIDEALNTAHHSFEQLSIAGKALEHMQKQTIEERERVIEVVEKQFDQLLAFFDSRKKNLCEEFARTTDDYLSNLIKAKSYIEEKKNNLNAAMNIARALQLSPSLRTYCDLNQIIRTLQLTSDSELAQVSSPQLRNPPRLSVNCSEIICMFNNMGKIEFRDSTKCYPQENEIRQNVQKKYNNKKELSCYDTYPPLEKKKVDMSVLTSEAPPPPLQPETNDVHLEAKNFQPQKDVATASPKTIAVLPQMGSSPDVIIEEIIEDNVESSAELVFVSHVIDPCHFYIRKYSQIKDAKVLEKKVNEFCNRSSHLDPSDILELGARIFVSSIKNGMWCRGTITELIPIEGRNTRKPCSPTRLFVHEVALIQIFMVDFGNSEVLIVTGVVDTHVRPEHSAKQHIALNDLCLVLRKSEPYTEGLLKDIQPLAQPCSLKDIVPQNSNEGWEEEAKVEFLKMVNNKAVSMKVFREEDGVLIVDLQKPPPNKISSDMPVSLRDALVFMELAKFKSQSLRSHFEKNTTLHYHPPILPKEMTDVSVTVCHINSPGDFYLQLIEGLDILFLLKTIEEFYKSEDGENLEILCPVQDQACVAKFEDGIWYRAKVIGLPGHQEVEVKYVDFGNTAKITIKDVRKIKDEFLNAPEKAIKCKLAYIEPYKRTMQWSKEAKEKFEEKAQDKFMTCSVIKILEDNVLLVELFDSLGAPEMTTTSINDQLVKEGLASYEIGYILKDNSQKHIEVWDPSPEEIISNEVHNLNPVSAKSLPNENFQSLYNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKRQVDIHIMKPRSDHDKKYEEEQWEIRFEELLSAETDTPLLPPYLSSSLPSPGELYAVQVKHVVSPNEVYICLDSIETSNQSNQHSDTDDSGVSGESESESLDEALQRVNKKVEALPPLTDFRTEMPCLAEYDDGLWYRAKIVAIKEFNPLSILVQFVDYGSTAKLTLNRLCQIPSHLMRYPARAIKVLLAGFKPPLRDLGETRIPYCPKWSMEALWAMIDCLQGKQLYAVSMAPAPEQIVTLYDDEQHPVHMPLVEMGLADKDE

SEQ ID NO: 62267 - protein, 1068 aa, Homo sapiens
MLDTNTAEEIDEALNTAHHSFEQLSIAGKALEHMQKQTIEERERVIEVVEKQFDQLLAFFDSRKKNLCEEFARTTDDYLSNLIKAKSYIEEKKNNLNAAMNIARALQLSPSLRTYCDLNQIIRTLQLTSDSELAQVSSPQLRNPPRLSVNCSEIICMFNNMGKIEFRDSTKCYPQENEIRQNVQKKYNNKKELSCYDTYPPLEKKKVDMSVLTSEAPPPPLQPETNDVHLEAKNFQPQKDVATASPKTIAVLPQMGSSPDVIIEEIIEDNVESSAELVFVSHVIDPCHFYIRKYSQIKDAKVLEKKVNEFCNRSSHLDPSDILELGARIFVSSIKNGMWCRGTITELIPIEGRNTRKPCSPTRLFVHEVALIQIFMVDFGNSEVLIVTGVVDTHVRPEHSAKQHIALNDLCLVLRKSEPYTEGLLKDIQPLAQPCSLKDIVPQNSNEGWEEEAKVEFLKMVNNKAVSMKVFREEDGVLIVDLQKPPPNKISSDMPVSLRDALVFMELAKFKSQSLRSHFEKNTTLHYHPPILPKEMTDVSVTVCHINSPGDFYLQLIEGLDILFLLKTIEEFYKSEDGENLEILCPVQDQACVAKFEDGIWYRAKVIGLPGHQEVEVKYVDFGNTAKITIKDVRKIKDEFLNAPEKAIKCKLAYIEPYKRTMQWSKEAKEKFEEKAQDKFMTCSVIKILEDNVLLVELFDSLGAPEMTTTSINDQLVKEGLASYEIGYILKDNSQKHIEVWDPSPEEIISNEVHNLNPVSAKSLPNENFQSLYNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIK

SEQ ID NO: 62268 - protein, 153 aa, Homo sapiens
MASYFDEHDCEPSDPEQETRTNMLLELARSLFNRMDFEDLGLVVDWDHHLPPPAAKTVVENLPRTVIRGSQAELKCPVCLLEFEEEETAIEMPCHHLFHSSCILPWLSKTNSCPLCRYELPTDDDTYEEHRRDKARKQQQQHRLENLHGAMYT

SEQ ID NO: 62269 - protein, 227 aa, Homo sapiens
MACTKTLQQSQPISAGATTTTTAVAPAGGHSGSTECDLECLVCREPYSCPRLPKLLACQHAFCAICLKLLLCVQDNTWSITCPLCRKVTAVPGGLICSLRDHEAVVGQLAQPCTEVSLCPQGLVDPADLAAGHPSLVGEDGQDEVSANHVAARRLAAHLLLLALLIILIGPFIYPGVLRWVLTFIIALALLMSTLFCCLPSTRGSCWPSSRTLFCREQKHSHISSIA

SEQ ID NO: 62270 - protein, 264 aa, Homo sapiens
MSQAVQTNGTQPLSKTWELSLYELQRTPQEAITDGLEIVVSPRSLHSELMCPICLDMLKNTMTTKECLHRFCADCIITALRSGLQRGKKQQIENGSGAEDNGDSSHCSNASTHSNQEAGPSNKRTKTSDDSGLELDNNNAAMAIDPVMDGASEIELVFRPHPTLMEKDDSAQTRYIKTSGNATVDHLSKYLAVRLALEELRSKGESNQMNLDTASEKQYTIYIATASGQFTVLNGSFSLELVSEKYWKVNKPMELYYAPTKEHK

SEQ ID NO: 62271 - protein, 336 aa, Homo sapiens
MSQAVQTNGTQPLSKTWELSLYELQRTPQEAITDGLEIVVSPRSLHSELMCPICLDMLKNTMTTKECLHRFCADCIITALRSGNKECPTCRKKLVSKRSLRPDPNFDALISKIYPSRDEYEAHQERVLARINKHNNQQALSHSIEEGLKIQAMNRLQRGKKQQIENGSGAEDNGDSSHCSNASTHSNQEAGPSNKRTKTSDDSGLELDNNNAAMAIDPVMDGASEIELVFRPHPTLMEKDDSAQTRYIKTSGNATVDHLSKYLAVRLALEELRSKGESNQMNLDTASEKQYTIYIATASGQFTVLNGSFSLELVSEKYWKVNKPMELYYAPTKEHK

SEQ ID NO: 62272 - protein, 246 aa, Homo sapiens
MSQAVQTNGTQPLSKTWELSLYELQRTPQEAITDGLEIVVSPRSLHSELMCPICLDMLKNTMTTKECLHRFCADCIITALRSGNKECPTCRKKLVSKRSLRPDPNFDALISKIYPSRDEYEAHQERVLARINKHNNQQALSHSIEEGLKIQAMNRLQRGKKQQIENGSGAEDNGDSSHCSNASTHSNQEAGPSNKRTKTSDDSGLELDNNNAAMAIDPVMDGASEIELVFRPHPTLMEKDDSAQTR

SEQ ID NO: 62273 - protein, 273 aa, Homo sapiens
MANWVFCNRCFQPPHRTSCFSLTNCGHVYCDACLGKGKKNECLICKAPCRTVLLSKHTDADIQAFFMSIDSLCKKYSRETSQYLRLSRGCCRLKLCPATSSKEVPRGSTHGSQAAARDPQEHWVSTTRAPRPGCRRSQSQPEAQGNTIQDAPHPLTLLHPSRTLIHTKSPWGQKLLEFIKHVCYHRHQSHRPCAPGWFCQVLQRPGAVSGEKTQQTRPAPPATCLLCLSCLSGFRHGPWRSQALPSDLVAPLFVSYTVEVSITNAGWSFPAAV

SEQ ID NO: 62274 - protein, 232 aa, Homo sapiens
MANWVFCNRCFQPPHRTSCFSLTNCGHVYCDACLGKGKKNECLICKAPCRTVLLSKHTDADIQAFFMSIDSLCKKYSRETSQILEFQEKHRKRLLAFYREKISRLEESLRKSVLQIEQLQSMRSSQQTAFSTIKSSVSTKPHGCLLPPHSSAPDRLESMEVDLSPSPIRKSEIAAGPARISMISPPQDGRMAPCARRVCHFQRFTMFLHRRLSSLAAPPSVQFWKARGTHQL

SEQ ID NO: 62275 - protein, 297 aa, Homo sapiens
MANWVFCNRCFQPPHRTSCFSLTNCGHVYCDACLGKGKKNECLICKAPCRTVLLSKHTDADIQAFFMSIDSLCKKYSRETSQILEFQEKHRKRLLAFYREKISRLEESLRKSVLQIEQLQSMRSSQQTAFSTIKSSVSTKPHGCLLPPHSSAPDRLESMEVDLSPSPIRKSEIAAGPARISMISPPQDGRMGPHLTASFCFIPWLTLSKPPVPGECVISRGSPCFCIDVCPHWLLLLAFSSGRHGELTNSKTLPIYAEVQRAVLFPFQQAEGTLDTFRTPAVSVVFPLCQFERKKSF

SEQ ID NO: 62276 - protein, 1063 aa, Homo sapiens
MECPSCQHVSKEETPKFCSQCGERLPPAAPIADSENNNSTMASASEGEMECGQELKEEGGPCLFPGSDSWQENPEEPCSKASWTVQESKKKKRKKKKKGNKSASSELASLPLSPASPCHLTLLSNPWPQDTALPHSQAQQSGPTGQPSQPPGTATTPLEGDGLSAPTEVGDSPLQAQALGEAGVATGSEAQSSPQFQDHTEGEDQDASIPSGGRGLSQEGTGPPTSAGEGHSRTEDAAQELLLPESKGGSSEPGTELQTTEQQAGASASMAVDAVAEPANAVKGAGKEMKEKTQRMKQPPATTPPFKTHCQEAETKTKDEMAAAEEKVGKNEQGEPEDLKKPEGKNRSAAAVKNEKEQKNQEADVQEVKASTLSPGGGVTVFFHAIISLHFPFNPDLHKVFIRGGEEFGESKWDSNICELHYTRDLGHDRVLVEGIVCISKKHLDKYIPYKYVIYNGESFEYEFIYKHQQKKGEYVNRCLFIKSSLLGSGDWHQYYDIVYMKPHGRLQKVMNHITDGPRKDLVKGKQIAAALMLDSTFSILQTWDTINLNSFFTQFEQFCFVLQQPMIYEGQAQLWTDLQYREKEVKRYLWQHLKKHVVPLPDGKSTDFLPVDCPVRSKLKTGLIVLFVVEKIELLLEGSLDWLCHLLTSDASSPDEFHRDLSHILGIPQSWRLYLVNLCQRCMDTRTYTWLGALPVLHCCMELAPRHKDAWRQPEDTWAALEGLSFSPFREQMLDTSSLLQFMREKQHLLSIDEPLFRSWFSLLPLSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQVNNLSSWETDSGSQLCSAMTQLRAMKHPLGLSSSANSEIGKWAPSSLAKGNGAEI

SEQ ID NO: 62277 - protein, 3280 aa, Homo sapiens
MVCDGDWEHCYLPSAFSQHKVFVTPQAPLEAIQAYLAGHYRVPKQTLSAAAVFNDRLCVGIVASERAGVGKSLYVKRLHDKMKMQLNVKNVPLKTIRLIDPQVDESRVLGALLPFLDAQYQKVPVLFHLDVTSSVQTGIWVFLFKLLILQYLMDINGKMWLRNPCHLYIVEILERRTSVPSRSSSALRTRVPQFSFLDIFPKVTCRPPKEVIDMELSALRSDTEPGMDLWEFCSETFQRPYQYLRRFNQNQDLDTFQYQEGSVEGTPEECLQHFLFHCGVINPSWSELRNFARFLNYQLRDCEASLFCNPSFIGDTLRGFKKFVVTFMIFMARDFATPSLHTSDQSPGKHMVTMDGVREEDLAPFSLRKRWESEPHPYVFFNDDHTTMTFIGFHLQPNINGSVDAISHLTGKVIKRDVMTRDLYQGLLLQRVPFNVDFDKLPRHKKLERLCLTLGIPQATDPDKTYELTTDNMLKILAIEMRFRCGIPVIIMGETGCGKTRLIKFLSDLRRGGTNADTIKLVKVHGGTTADMIYSRVREAENVAFANKDQHQLDTILFFDEANTTEAISCIKEVLCDHMVDGQPLAEDSGLHIIAACNPYRKHSEEMICRLESAGLGYRVSMEETADRLGSIPLRQLVYRVHALPPSLIPLVWDFGQLSDVAEKLYIQQIVQRLVESISLDENGTRVITEVLCASQGFMRKTEDECSFVSLRDVERCVKVFRWFHEHSAMLLAQLNAFLSKSSVSKNHTERDPVLWSLMLAIGVCYHASLEKKDSYRKAIARFFPKPYDDSRLLLDEITRAQDLFLDGVPLRKTIAKNLALKENVFMMVVCIELKIPLFLVGKPGSSKSLAKTIVADAMQGPAAYSDLFRSLKQVHLVSFQCSPHSTPQGIISTFRQCARFQQGKDLQQYVSVVVLDEVGLAEDSPKMPLKTLHPLLEDGCIEDDPAPHKKVGFVGISNWALDPAKMNRGIFVSRGSPNETELIESAKGICSSDILVQDRVQGYFASFAKAYETVCKRQDKEFFGLRDYYSLIKMVFAAAKASNRKPSPQDIAQAVLRNFSGKDDIQALDIFLANLPEAKCSEEVSPMQLIKQNIFGPSQKVPGGEQEDAESRYLLVLTKNYVALQILQQTFFEGDQQPEIIFGSGFPKDQEYTQLCRNINRVKICMETGKMVLLLNLQNLYESLYDALNQYYVHLGGQKYVDLGLGTHRVKCRVHPNFRLIVIEEKDVVYKHFPIPLINRLEKHYLDINTVLEKWQKSIVEELCAWVEKFINVKAHHFQKRHKYSPSDVFIGYHSDACASVVLQVIERQGPRALTEELHQKVSEEAKSILLNCATPDAVVRLSAYSLGGFAAEWLSQEYFHRQRHNSFADFLQAHLHTADLERHAIFTEITTFSRLLTSHDCEILESEVTGRAPKPTLLWLQQFDTEYSFLKEVRNCLTNTAKCKILIFQTDFEDGIRSAQLIASAKYSVINEINKIRENEDRIFVYFITKLSRVGRGTAYVGFHGGLWQSVHIDDLRRSTLMVSDVTRLQHVTISQLFAPGDLPELGLEHRAEDGHEEAMETEASTSGEVAEVAEEAMETESSEKVGKETSELGGSDVSILDTTRLLRSCVQSAVGMLRDQNESCTRNMRRVVLLLGLLNEDDACHASFLRVSKMRLSVFLKKQEESQFHPLEWLAREACNQDALQEAGTFRHTLWKRVQGAVTPLLASMISFIDRDGNLELLTRPDTPPWARDLWMFIFSDTMLLNIPLVMNNERHKGEMAYIVVQNHMNLSENASNNVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 62278 - protein, 1550 aa, Homo sapiens
MECPSCQHVSKEETPKFCSQCGERLPPAAPIADSENNNSTMASASEGEMECGQELKEEGGPCLFPGSDSWQENPEEPCSKASWTVQESKKKKRKKKKKGNKSASSELASLPLSPASPCHLTLLSNPWPQDTALPHSQAQQSGPTGQPSQPPGTATTPLEGDGLSAPTEVGDSPLQAQALGEAGVATGSEAQSSPQFQDHTEGEDQDASIPSGGRGLSQEGTGPPTSAGEGHSRTEDAAQELLLPESKGGSSEPGTELQTTEQQAGASASMAVDAVAEPANAVKGAGKEMKEKTQRMKQPPATTPPFKTHCQEAETKTKDEMAAAEEKVGKNEQGEPEDLKKPEGKNRSAAAVKNEKEQKNQEADVQEVKASTLSPGGGVTVFFHAIISLHFPFNPDLHKVFIRGGEEFGESKWDSNICELHYTRDLGHDRVLVEGIVCISKKHLDKYIPYKYVIYNGESFEYEFIYKHQQKKGEYVNRCLFIKSSLLGSGDWHQYYDIVYMKPHGRLQKVMNHITDGPRKDLVKGKQIAAALMLDSTFSILQTWDTINLNSFFTQFEQFCFVLQQPMIYEGQAQLWTDLQYREKEVKRYLWQHLKKHVVPLPDGKSTDFLPVDCPVRSKLKTGLIVLFVVEKIELLLEGSLDWLCHLLTSDASSPDEFHRDLSHILGIPQSWRLYLVNLCQRCMDTRTYTWLGALPVLHCCMELAPRHKDAWRQPEDTWAALEGLSFSPFREQMLDTSSLLQFMREKQHLLSIDEPLFRSWFSLLPLSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQSQTSILQGFSYSDLRKFGIVLSAVITKSWPRTADNFNDILKHLLTLADVKHVFRLCGTDEKILANVTEDAKRLIAVADSVLTKVVGDLLSGTILVGQLELIIKHKNQFLDIWQLREKSLSPQDEQCAVEEALDWRREELLLLKKEKRCVDSLLKMCGNVKHLIQVDFGVLAVRHSQDLSSKRLNDTVTVRLSTSSNSQRATHYHLSSQVQEMAGKIDLLRDSHIFQLFWREAAEPLSEPKEDQEAAELLSEPEEESERHILELEEVYDYLYQPSYRKFIKLHQDLKSGEVTLAEIDVIFKDFVNKYTDLDSELKIMCTVDHQDQRDWIKDRVEQIKEYHHLHQAVHAAKVILQVKESLGLNGDFSVLNTLLNFTDNFDDFRRETLDQINQELIQAKKLLQDISEARCKGLQALSLRKEFICWVREALGGINELKVFVDLASISAGENDIDVDRVACFHDAVQGYASLLFKLDPSVDFSAFMKHLKKLWKALDKDQYLPRKLVSLILSLMQILLNRALLSNVRAVTVEMVAHLCGRFVHSRFQ

SEQ ID NO: 62279 - protein, 5256 aa, Homo sapiens
MECPSCQHVSKEETPKFCSQCGERLPPAAPIADSENNNSTMASASEGEMECGQELKEEGGPCLFPGSDSWQENPEEPCSKASWTVQEGATSEVLVDAAVDLISDEWEAANAIPSKRRKQDAAPLEAASVPSADCEQSKKKKRKKKKKGNKSASSELASLPLSPASPCHLTLLSNPWPQDTALPHSQAQQSGPTGQPSQPPGTATTPLEGDGLSAPTEVGDSPLQAQALGEAGVATGSEAQSSPQFQDHTEGEDQDASIPSGGRGLSQEGTGPPTSAGEGHSRTEDAAQELLLPESKGGSSEPGTELQTTEQQAGASASMAVDAVAEPANAVKGAGKEMKEKTQRMKQPPATTPPFKTHCQEAETKTKDEMAAAEEKVGKNEQGEPEDLKKPEGKNRSAAAVKNEKEQKNQEADVQEVKASTLSPGGGVTVFFHAIISLHFPFNPDLHKVFIRGGEEFGESKWDSNICELHYTRDLGHDRVLVEGIVCISKKHLDKYIPYKYVIYNGESFEYEFIYKHQQKKGEYVNRCLFIKSSLLGSGDWHQYYDIVYMKPHGRLQKVMNHITDGPRKDLVKGKQIAAALMLDSTFSILQTWDTINLNSFFTQFEQFCFVLQQPMIYEGQAQLWTDLQYREKEVKRYLWQHLKKHVVPLPDGKSTDFLPVDCPVRSKLKTGLIVLFVVEKIELLLEGSLDWLCHLLTSDASSPDEFHRDLSHILGIPQSWRLYLVNLCQRCMDTRTYTWLGALPVLHCCMELAPRHKDAWRQPEDTWAALEGLSFSPFREQMLDTSSLLQFMREKQHLLSIDEPLFRSWFSLLPLSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQSQTSILQGFSYSDLRKFGIVLSAVITKSWPRTADNFNDILKHLLTLADVKHVFRLCGTDEKILANVTEDAKRLIAVADSVLTKVVGDLLSGTILVGQLELIIKHKNQFLDIWQLREKSLSPQDEQCAVEEALDWRREELLLLKKEKRCVDSLLKMCGNVKHLIQVDFGVLAVRHSQDLSSKRLNDTVTVRLSTSSNSQRATHYHLSSQVQEMAGKIDLLRDSHIFQLFWREAAEPLSEPKEDQEAAELLSEPEEESERHILELEEVYDYLYQPSYRKFIKLHQDLKSGEVTLAEIDVIFKDFVNKYTDLDSELKIMCTVDHQDQRDWIKDRVEQIKEYHHLHQAVHAAKVILQVKESLGLNGDFSVLNTLLNFTDNFDDFRRETLDQINQELIQAKKLLQDISEARCKGLQALSLRKEFICWVREALGGINELKVFVDLASISAGENDIDVDRVACFHDAVQGYASLLFKLDPSVDFSAFMKHLKKLWKALDKDQYLPRKLCDSARNLEWLKTVNESHGSVERSSLTLATAINQRGIYVIQAPKGGQKISPDTVLHLILPESPGSHEESREYSLEEVKELLNKLMLMSGKKDRNNTEVERFSEVFCSVQRLSQAFIDLHSAGNMLFRTWIAMAYCSPKQGVSLQMDFGLDLVTELKEGGDVTELLAALCRQMEHFLDSWKRFVTQKRMEHFYLNFYTAEQLVYLSTELRKQPPSDAALTMLSFIKSNCTLRDVLRASVGCGSEAARYRMRRVMEELPLMLLSEFSLVDKLRIIMEQSMRCLPAFLPDCLDLETLGHCLAHLAGMGGSPVERCLPRGLQVGQPNLVVCGHSEVLPAALAVYMQTPSQPLPTYDEVLLCTPATTFEEVALLLRRCLTLGSLGHKVYSLLFADQLSYEVARQAEELFHNLCTQQHREDYQLVMVCDGDWEHCYLPSAFSQHKVFVTPQAPLEAIQAYLAGHYRVPKQTLSAAAVFNDRLCVGIVASERAGVGKSLYVKRLHDKMKMQLNVKNVPLKTIRLIDPQVDESRVLGALLPFLDAQYQKVPVLFHLDVTSSVQTGIWVFLFKLLILQYLMDINGKMWLRNPCHLYIVEILERRTSVPSRSSSALRTRVPQFSFLDIFPKVTCRPPKEVIDMELSALRSDTEPGMDLWEFCSETFQRPYQYLRRFNQNQDLDTFQYQEGSVEGTPEECLQHFLFHCGVINPSWSELRNFARFLNYQLRDCEASLFCNPSFIGDTLRGFKKFVVTFMIFMARDFATPSLHTSDQSPGKHMVTMDGVREEDLAPFSLRKRWESEPHPYVFFNDDHTTMTFIGFHLQPNINGSVDAISHLTGKVIKRDVMTRDLYQGLLLQRVPFNVDFDKLPRHKKLERLCLTLGIPQATDPDKTYELTTDNMLKILAIEMRFRCGIPVIIMGETGCGKTRLIKFLSDLRRGGTNADTIKLVKVHGGTTADMIYSRVREAENVAFANKDQHQLDTILFFDEANTTEAISCIKEVLCDHMVDGQPLAEDSGLHIIAACNPYRKHSEEMICRLESAGLGYRVSMEETADRLGSIPLRQLVYRVHALPPSLIPLVWDFGQLSDVAEKLYIQQIVQRLVESISLDENGTRVITEVLCASQGFMRKTEDECSFVSLRDVERCVKVFRWFHEHSAMLLAQLNAFLSKSSVSKNHTERDPVLWSLMLAIGVCYHASLEKKDSYRKAIARFFPKPYDDSRLLLDEITRAQDLFLDGVPLRKTIAKNLALKENVFMMVVCIELKIPLFLVGKPGSSKSLAKTIVADAMQGPAAYSDLFRSLKQVHLVSFQCSPHSTPQGIISTFRQCARFQQGKDLQQYVSVVVLDEVGLAEDSPKMPLKTLHPLLEDGCIEDDPAPHKKVGFVGISNWALDPAKMNRGIFVSRGSPNETELIESAKGICSSDILVQDRVQGYFASFAKAYETVCKRQDKEFFGLRDYYSLIKMVFAAAKASNRKPSPQDIAQAVLRNFSGKDDIQALDIFLANLPEAKCSEEVSPMQLIKQNIFGPSQKVPGGEQEDAESRYLLVLTKNYVALQILQQTFFEGDQQPEIIFGSGFPKDQEYTQLCRNINRVKICMETGKMVLLLNLQNLYESLYDALNQYYVHLGGQKYVDLGLGTHRVKCRVHPNFRLIVIEEKDVVYKHFPIPLINRLEKHYLDINTVLEKWQKSIVEELCAWVEKFINVKAHHFQKRHKYSPSDVFIGYHSDACASVVLQVIERQGPRALTEELHQKVSEEAKSILLNCATPDAVVRLSAYSLGGFAAEWLSQEYFHRQRHNSFADFLQAHLHTADLERHAIFTEITTFSRLLTSHDCEILESEVTGRAPKPTLLWLQQFDTEYSFLKEVRNCLTNTAKCKILIFQTDFEDGIRSAQLIASAKYSVINEINKIRENEDRIFVYFITKLSRVGRGTAYVGFHGGLWQSVHIDDLRRSTLMVSDVTRLQHVTISQLFAPGDLPELGLEHRAEDGHEEAMETEASTSGEVAEVAEEAMETESSEKVGKETSELGGSDVSILDTTRLLRSCVQSAVGMLRDQNESCTRNMRRVVLLLGLLNEDDACHASFLRVSKMRLSVFLKKQEESQFHPLEWLAREACNQDALQEAGTFRHTLWKRVQGAVTPLLASMISFIDRDGNLELLTRPDTPPWARDLWMFIFSDTMLLNIPLVMNNERHKGEMAYIVVQNHMNLSENASNNVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 62280 - protein, 5207 aa, Homo sapiens
MECPSCQHVSKEETPKFCSQCGERLPPAAPIADSENNNSTMASASEGEMECGQELKEEGGPCLFPGSDSWQENPEEPCSKASWTVQESKKKKRKKKKKGNKSASSELASLPLSPASPCHLTLLSNPWPQDTALPHSQAQQSGPTGQPSQPPGTATTPLEGDGLSAPTEVGDSPLQAQALGEAGVATGSEAQSSPQFQDHTEGEDQDASIPSGGRGLSQEGTGPPTSAGEGHSRTEDAAQELLLPESKGGSSEPGTELQTTEQQAGASASMAVDAVAEPANAVKGAGKEMKEKTQRMKQPPATTPPFKTHCQEAETKTKDEMAAAEEKVGKNEQGEPEDLKKPEGKNRSAAAVKNEKEQKNQEADVQEVKASTLSPGGGVTVFFHAIISLHFPFNPDLHKVFIRGGEEFGESKWDSNICELHYTRDLGHDRVLVEGIVCISKKHLDKYIPYKYVIYNGESFEYEFIYKHQQKKGEYVNRCLFIKSSLLGSGDWHQYYDIVYMKPHGRLQKVMNHITDGPRKDLVKGKQIAAALMLDSTFSILQTWDTINLNSFFTQFEQFCFVLQQPMIYEGQAQLWTDLQYREKEVKRYLWQHLKKHVVPLPDGKSTDFLPVDCPVRSKLKTGLIVLFVVEKIELLLEGSLDWLCHLLTSDASSPDEFHRDLSHILGIPQSWRLYLVNLCQRCMDTRTYTWLGALPVLHCCMELAPRHKDAWRQPEDTWAALEGLSFSPFREQMLDTSSLLQFMREKQHLLSIDEPLFRSWFSLLPLSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQSQTSILQGFSYSDLRKFGIVLSAVITKSWPRTADNFNDILKHLLTLADVKHVFRLCGTDEKILANVTEDAKRLIAVADSVLTKVVGDLLSGTILVGQLELIIKHKNQFLDIWQLREKSLSPQDEQCAVEEALDWRREELLLLKKEKRCVDSLLKMCGNVKHLIQVDFGVLAVRHSQDLSSKRLNDTVTVRLSTSSNSQRATHYHLSSQVQEMAGKIDLLRDSHIFQLFWREAAEPLSEPKEDQEAAELLSEPEEESERHILELEEVYDYLYQPSYRKFIKLHQDLKSGEVTLAEIDVIFKDFVNKYTDLDSELKIMCTVDHQDQRDWIKDRVEQIKEYHHLHQAVHAAKVILQVKESLGLNGDFSVLNTLLNFTDNFDDFRRETLDQINQELIQAKKLLQDISEARCKGLQALSLRKEFICWVREALGGINELKVFVDLASISAGENDIDVDRVACFHDAVQGYASLLFKLDPSVDFSAFMKHLKKLWKALDKDQYLPRKLCDSARNLEWLKTVNESHGSVERSSLTLATAINQRGIYVIQAPKGGQKISPDTVLHLILPESPGSHEESREYSLEEVKELLNKLMLMSGKKDRNNTEVERFSEVFCSVQRLSQAFIDLHSAGNMLFRTWIAMAYCSPKQGVSLQMDFGLDLVTELKEGGDVTELLAALCRQMEHFLDSWKRFVTQKRMEHFYLNFYTAEQLVYLSTELRKQPPSDAALTMLSFIKSNCTLRDVLRASVGCGSEAARYRMRRVMEELPLMLLSEFSLVDKLRIIMEQSMRCLPAFLPDCLDLETLGHCLAHLAGMGGSPVERCLPRGLQVGQPNLVVCGHSEVLPAALAVYMQTPSQPLPTYDEVLLCTPATTFEEVALLLRRCLTLGSLGHKVYSLLFADQLSYEVARQAEELFHNLCTQQHREDYQLVMVCDGDWEHCYLPSAFSQHKVFVTPQAPLEAIQAYLAGHYRVPKQTLSAAAVFNDRLCVGIVASERAGVGKSLYVKRLHDKMKMQLNVKNVPLKTIRLIDPQVDESRVLGALLPFLDAQYQKVPVLFHLDVTSSVQTGIWVFLFKLLILQYLMDINGKMWLRNPCHLYIVEILERRTSVPSRSSSALRTRVPQFSFLDIFPKVTCRPPKEVIDMELSALRSDTEPGMDLWEFCSETFQRPYQYLRRFNQNQDLDTFQYQEGSVEGTPEECLQHFLFHCGVINPSWSELRNFARFLNYQLRDCEASLFCNPSFIGDTLRGFKKFVVTFMIFMARDFATPSLHTSDQSPGKHMVTMDGVREEDLAPFSLRKRWESEPHPYVFFNDDHTTMTFIGFHLQPNINGSVDAISHLTGKVIKRDVMTRDLYQGLLLQRVPFNVDFDKLPRHKKLERLCLTLGIPQATDPDKTYELTTDNMLKILAIEMRFRCGIPVIIMGETGCGKTRLIKFLSDLRRGGTNADTIKLVKVHGGTTADMIYSRVREAENVAFANKDQHQLDTILFFDEANTTEAISCIKEVLCDHMVDGQPLAEDSGLHIIAACNPYRKHSEEMICRLESAGLGYRVSMEETADRLGSIPLRQLVYRVHALPPSLIPLVWDFGQLSDVAEKLYIQQIVQRLVESISLDENGTRVITEVLCASQGFMRKTEDECSFVSLRDVERCVKVFRWFHEHSAMLLAQLNAFLSKSSVSKNHTERDPVLWSLMLAIGVCYHASLEKKDSYRKAIARFFPKPYDDSRLLLDEITRAQDLFLDGVPLRKTIAKNLALKENVFMMVVCIELKIPLFLVGKPGSSKSLAKTIVADAMQGPAAYSDLFRSLKQVHLVSFQCSPHSTPQGIISTFRQCARFQQGKDLQQYVSVVVLDEVGLAEDSPKMPLKTLHPLLEDGCIEDDPAPHKKVGFVGISNWALDPAKMNRGIFVSRGSPNETELIESAKGICSSDILVQDRVQGYFASFAKAYETVCKRQDKEFFGLRDYYSLIKMVFAAAKASNRKPSPQDIAQAVLRNFSGKDDIQALDIFLANLPEAKCSEEVSPMQLIKQNIFGPSQKVPGGEQEDAESRYLLVLTKNYVALQILQQTFFEGDQQPEIIFGSGFPKDQEYTQLCRNINRVKICMETGKMVLLLNLQNLYESLYDALNQYYVHLGGQKYVDLGLGTHRVKCRVHPNFRLIVIEEKDVVYKHFPIPLINRLEKHYLDINTVLEKWQKSIVEELCAWVEKFINVKAHHFQKRHKYSPSDVFIGYHSDACASVVLQVIERQGPRALTEELHQKVSEEAKSILLNCATPDAVVRLSAYSLGGFAAEWLSQEYFHRQRHNSFADFLQAHLHTADLERHAIFTEITTFSRLLTSHDCEILESEVTGRAPKPTLLWLQQFDTEYSFLKEVRNCLTNTAKCKILIFQTDFEDGIRSAQLIASAKYSVINEINKIRENEDRIFVYFITKLSRVGRGTAYVGFHGGLWQSVHIDDLRRSTLMVSDVTRLQHVTISQLFAPGDLPELGLEHRAEDGHEEAMETEASTSGEVAEVAEEAMETESSEKVGKETSELGGSDVSILDTTRLLRSCVQSAVGMLRDQNESCTRNMRRVVLLLGLLNEDDACHASFLRVSKMRLSVFLKKQEESQFHPLEWLAREACNQDALQEAGTFRHTLWKRVQGAVTPLLASMISFIDRDGNLELLTRPDTPPWARDLWMFIFSDTMLLNIPLVMNNERHKGEMAYIVVQNHMNLSENASNNVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 62281 - protein, 923 aa, Homo sapiens
MEEGNNNEEVIHLNNFHCHRGQEWINLRDGPITISDSSDEERIPMLVTPAPQQHEEEDLDDDVILTETNKPQRSRPNLIKPAAQWQDLKRLGEERPKKSRAAFESDKSSYFSVCNNPLFDSGAQDDSEDDYGEFLDLGPPGISEFTKPSGQTEREPKPGPSHNQAANDIVNPRSEQKVIILEEGSLLYTESDPLETQNQSSEDSETELLSNLGESAALADDQAIEEDCWLDHPYFQSLNQQPREITNQVVPQERQPEAELGRLLFQHEFPGPAFPRPEPQQGGISGPSSPQPAHPLGEFEDQQLASDDEEPGPAFPMQESQEPNLENIWGQEAAEVDQELVELLVKETEARFPDVANGFIEEIIHFKNYYDLNVLCNFLLENPDYPKREDRIIINPSSSLLASQDETKLPKIDFFDYSKLTPLDQRCFIQAADLLMADFKVLSSQDIKWALHELKGHYAITRKALSDAIKKWQELSPETSGKRKKRKQMNQYSYIDFKFEQGDIKIEKRMFFLENKRRHCRSYDRRALLPAVQQEQEFYEQKIKEMAEHEDFLLALQMNEEQYQKDGQLIECRCCYGEFPFEELTQCADAHLFCKECLIRYAQEAVFGSGKLELSCMEGSCTCSFPTSELEKVLPQTILYKYYERKAEEEVAAAYADELVRCPSCSFPALLDSDVKRFSCPNPHCRKETCRKCQGLWKEHNGLTCEELAEKDDIKYRTSIEEKMTAARIRKCHKCGTGLIKSEGCNRMSCRCGAQMCYLCRVSINGYDHFCQHPRSPGAPCQECSRCSLWTDPTEDDEKLIEEIQKEAEEEQKRKNGENTFKRIGPPLEKPVEKVQRVEALPRPVPQNLPQPQMPPYAFAHPPFPLPPVRPVFNNFPLNMGPIPAPYVPPLPNVRVNYDFGPIHMPLEHNLPMHFGPQPRHRF

SEQ ID NO: 62282 - protein, 20 aa, Homo sapiens
MEEGNNNEEVIHLNNFHCHR

SEQ ID NO: 62283 - protein, 866 aa, Homo sapiens
MEEGNNNEEVIHLNNFHCHRGQEWINLRDGPITISDSSDEERIPMLVTPAPQQHEEEDLDDDVILTEDDSEDDYGEFLDLGPPGISEFTKPSGQTEREPKPGPSHNQAANDIVNPRSEQKVIILEEGSLLYTESDPLETQNQSSEDSETELLSNLGESAALADDQAIEEDCWLDHPYFQSLNQQPREITNQVVPQERQPEAELGRLLFQHEFPGPAFPRPEPQQGGISGPSSPQPAHPLGEFEDQQLASDDEEPGPAFPMQESQEPNLENIWGQEAAEVDQELVELLVKETEARFPDVANGFIEEIIHFKNYYDLNVLCNFLLENPDYPKREDRIIINPSSSLLASQDETKLPKIDFFDYSKLTPLDQRCFIQAADLLMADFKVLSSQDIKWALHELKGHYAITRKALSDAIKKWQELSPETSGKRKKRKQMNQYSYIDFKFEQGDIKIEKRMFFLENKRRHCRSYDRRALLPAVQQEQEFYEQKIKEMAEHEDFLLALQMNEEQYQKDGQLIECRCCYGEFPFEELTQCADAHLFCKECLIRYAQEAVFGSGKLELSCMEGSCTCSFPTSELEKVLPQTILYKYYERKAEEEVAAAYADELVRCPSCSFPALLDSDVKRFSCPNPHCRKETCRKCQGLWKEHNGLTCEELAEKDDIKYRTSIEEKMTAARIRKCHKCGTGLIKSEGCNRMSCRCGAQMCYLCRVSINGYDHFCQHPRSPGAPCQECSRCSLWTDPTEDDEKLIEEIQKEAEEEQKRKNGENTFKRIGPPLEKPVEKVQRVEALPRPVPQNLPQPQMPPYAFAHPPFPLPPVRPVFNNFPLNMGPIPAPYVPPLPNVRVNYDFGPIHMPLEHNLPMHFGPQPRHRF

SEQ ID NO: 62284 - protein, 678 aa, Homo sapiens
MEEGNNNEEVIHLNNFHCHRGQEWINLRDGPITISDSSDEERIPMLVTPAPQQHEEEDLDDDVILTETNKPQRSRPNLIKPAAQWQEAAEVDQELVELLVKETEARFPDVANGFIEEIIHFKNYYDLNVLCNFLLENPDYPKREDRIIINPSSSLLASQDETKLPKIDFFDYSKLTPLDQRCFIQAADLLMADFKVLSSQDIKWALHELKGHYAITRKALSDAIKKWQELSPETSGKRKKRKQMNQYSYIDFKFEQGDIKIEKRMFFLENKRRHCRSYDRRALLPAVQQEQEFYEQKIKEMAEHEDFLLALQMNEEQYQKDGQLIECRCCYGEFPFEELTQCADAHLFCKECLIRYAQEAVFGSGKLELSCMEGSCTCSFPTSELEKVLPQTILYKYYERKAEEEVAAAYADELVRCPSCSFPALLDSDVKRFSCPNPHCRKETCRKCQGLWKEHNGLTCEELAEKDDIKYRTSIEEKMTAARIRKCHKCGTGLIKSEGCNRMSCRCGAQMCYLCRVSINGYDHFCQHPRSPGAPCQECSRCSLWTDPTEDDEKLIEEIQKEAEEEQKRKNGENTFKRIGPPLEKPVEKVQRVEALPRPVPQNLPQPQMPPYAFAHPPFPLPPVRPVFNNFPLNMGPIPAPYVPPLPNVRVNYDFGPIHMPLEHNLPMHFGPQPRHRF

SEQ ID NO: 62285 - protein, 148 aa, Homo sapiens
MSSDFPHYNFRMPNIGFQNLPLNIYIVVFGTAIFVFILSLLFCCYLIRLRHQAHKEFYAYKQVILKEKVKELNLHELCAVCLEDFKPRDELGICPCKHAFHRKCLIKWLEVRKVCPLCNMPVLQLAQLHSKQDRGPPQGPLPGAENIV

SEQ ID NO: 62286 - protein, 148 aa, Homo sapiens; identical to SEQ ID NO: 62285

SEQ ID NO: 62287 - protein, 169 aa, Homo sapiens
MLNKSGESRYPALFPVLGGSSMSSDFPHYNFRMPNIGFQNLPLNIYIVVFGTAIFVFILSLLFCCYLIRLRHQAHKEFYAYKQVILKEKVKELNLHELCAVCLEDFKPRDELGICPCKHAFHRKCLIKWLEVRKVCPLCNMPVLQLAQLHSKQDRGPPQGPLPGAENIV

SEQ ID NO: 62288 - protein, 169 aa, Homo sapiens; identical to SEQ ID NO: 62287

SEQ ID NO: 62289 - protein, 433 aa, Homo sapiens
MEAVYLVVNGLGLVLDVLTLVLDLNFLLVSSLLASLAWLLAFVYNLPHTVLTSLLHLGRGVLLSLLALIEAVVRFTCGGLQALCTLLYSCCSGLESLKLLGHLASHGALRSREILHRGVLNVVSSGHALLRQACDICAIAMSLVAYVINSLVNICLIGTQNLFSLVLALWDAVTGPLWRMTDVVAAFLAHISSSAVAMAILLWTPCQLALELLASAARLLASFVLVNLTGLVLLACVLAVTVTVLHPDFTLRLATQALSQLHARPSYHRLREDVMRLSRLALGSEAWRRVWSRSLQLASWPNRGGAPGAPQGDPMRVFSVRTRRQDTLPEAGRRSEAEEEEARTIRVTPVRGRERLNEEEPPGGQDPWKLLKEQEERKKCVICQDQSKTVLLLPCRHLCLCQACTEILMRHPVYHRNCPLCRRGILQTLNVYL

SEQ ID NO: 62290 - protein, 1072 aa, Homo sapiens
MPGEEEERAFLVAREELASALRRDSGQAFSLEQLRPLLASSLPLAARYLQLDAARLVRCNAHGEPRNYLNTLSTALNILEKYGRNLLSPQRPRYWRGVKFNNPVFRSTVDAVQGGRDVLRLYGYTEEQPDGLSFPEGQEEPDEHQVATVTLEVLLLRTELSLLLQNTHPRQQALEQLLEDKVEDDMLQLSEFDPLLREIAPGPLTTPSVPGSTPGPCFLCGSAPGTLHCPSCKQALCPACDHLFHGHPSRAHHLRQTLPGVLQGTHLSPSLPASAQPRPQSTSLLALGDSSLSSPNPASAHLPWHCAACAMLNEPWAVLCVACDRPRGCKGLGLGTEGPQGTGGLEPDLARGRWACQSCTFENEAAAVLCSICERPRLAQPPSLVVDSRDAGICLQPLQQGDALLASAQSQVWYCIHCTFCNSSPGWVCVMCNRTSSPIPAQHAPRPYASSLEKGPPKPGPPRRLSAPLPSSCGDPEKQRQDKMREEGLQLVSMIREGEAAGACPEEIFSALQYSGTEVPLQWLRSELPYVLEMVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 62291 - protein, 505 aa, Homo sapiens
MPGEEEERAFLVAREELASALRRDSGQAFSLEQLRPLLASSLPLAARYLQLDAARLVRCNAHGEPRNYLNTLPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 62292 - protein, 921 aa, Homo sapiens
MDLCTRAGEPSLTQNTHPRQQALEQLLEDKVEDDMLQLSEFDPLLREIAPGPLTTPSVPGSTPGPCFLCGSAPGTLHCPSCKQALCPACDHLFHGHPSRAHHLRQTLPGVLQGTHLSPSLPASAQPRPQSTSLLALGDSSLSSPNPASAHLPWHCAACAMLNEPWAVLCVACDRPRGCKGLGLGTEGPQGTGGLEPDLARGRWACQSCTFENEAAAVLCSICERPRLAQPPSLVVDSRDAGICLQPLQQGDALLASAQSQVWYCIHCTFCNSSPGWVCVMCNRTSSPIPAQHAPRPYASSLEKGPPKPGPPRRLSAPLPSSCGDPEKQRQDKMREEGLQLVSMIREGEAAGACPEEIFSALQYSGTEVPLQWLRSELPYVLEMVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 62293 - protein, 170 aa, Homo sapiens
MPGEEEERAFLVAREELASALRRDSGQAFSLEQLRPLLASSLPLAARYLQLDAARLVRCNAHGEPRNYLNTLSTALNILEKYGRNLLSPQRPRYWRGVKFNNPVFRSTVDAVQGGRDVLRLYGYTEEQPDGLSFPEGQEEPDEHQVATVTLEVLLLRTELSLLLQNTHPR

SEQ ID NO: 62294 - protein, 56 aa, Homo sapiens
MPGEEEERAFLVAREELASALRRDSGQAFSLEQLRPLLASSLPLAARYLQLDAARL

SEQ ID NO: 62295 - protein, 373 aa, Homo sapiens
MRKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 62296 - protein, 372 aa, Homo sapiens
MKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 62297 - protein, 373 aa, Homo sapiens; identical to SEQ ID NO: 62295

SEQ ID NO: 62298 - protein, 515 aa, Homo sapiens
MACKISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 62299 - protein, 432 aa, Homo sapiens
MRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 62300 - protein, 465 aa, Homo sapiens
MACKSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 62301 - protein, 432 aa, Homo sapiens; identical to SEQ ID NO: 62299

SEQ ID NO: 62302 - protein, 439 aa, Homo sapiens
MQHTCTQQKKVTYKHIARFSPRNRLCQADAVFNNNLAGFQLQSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 62303 - protein, 332 aa, Homo sapiens
MVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 62304 - protein, 439 aa, Homo sapiens; identical to SEQ ID NO: 62302

SEQ ID NO: 62305 - protein, 432 aa, Homo sapiens; identical to SEQ ID NO: 62299

SEQ ID NO: 62306 - protein, 420 aa, Homo sapiens
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFDQLPAVLGAQGFGAGRHCWEVETADAASCRDSSGEDADDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 62307 - protein, 251 aa, Homo sapiens
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELLFGGGIPHSFLGTHSHAHCRSINSNPHFRPKIMRPHLVSTFPRPCSKPNPFLPSGSQNLLSPTATTVLPDFSHSNHSRPAMGNRPSPSVLVK

SEQ ID NO: 62308 - protein, 354 aa, Homo sapiens
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTPKSSNSEDDLPEDYPVVKKMLHRLTADLTLDPGTAHRRLLISTDRRSVQLAPPGTPAPPDGPKRFDQLPAVLGAQGFGAGRHCWEVETADAASCRDSSGEDEDDEESHYAVGAAGESVQRKGCAPGPLGERIFPLFCTCDPRAPLRIVPAES

SEQ ID NO: 62309 - protein, 354 aa, Homo sapiens
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFDQLPAVLGAQGFGAGRHCWEVETADAASCRDSSGEDADDEESHYAVGAAGESVQRKGCAPGPLGERIFPLFCTCDPRAPLRIVPAES

SEQ ID NO: 62310 - protein, 420 aa, Homo sapiens
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTPKSSNSEDDLPEDYPVVKKMLHRLTADLTLDPGTAHRRLLISTDRRSVQLAPPGTPAPPDGPKRFDQLPAVLGAQGFGAGRHCWEVETADAASCRDSSGEDEDDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 62311 - protein, 354 aa, Homo sapiens
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFNQLPAVLGAQGFGAGRHCWEVETADAASCRDSSGEDADDEESHYAVGAAGESVQRKGCAPGPLGERIFPLFCTCDPRAPLRIVPAES

SEQ ID NO: 62312 - protein, 420 aa, Homo sapiens
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFDQLPAVLGAQGFGAGRHCWEVETADAASCRDSSGEDADDEESHYAVGAAGESVQRKGCVRLCPAGAVWAVGGRGGRLWALTAPEPTLLGGVEPPPRRIRVDLDWERGRVAFYDGRSLDLLYAFQAPGPLGERIFPLFCTCDPRAPLRIVPAES

SEQ ID NO: 62313 - protein, 420 aa, Homo sapiens; identical to SEQ ID NO: 62306

SEQ ID NO: 62314 - protein, 420 aa, Homo sapiens; identical to SEQ ID NO: 62306

SEQ ID NO: 62315 - protein, 354 aa, Homo sapiens; identical to SEQ ID NO: 62309

SEQ ID NO: 62316 - protein, 354 aa, Homo sapiens; identical to SEQ ID NO: 62309

SEQ ID NO: 62317 - protein, 354 aa, Homo sapiens; identical to SEQ ID NO: 62309

SEQ ID NO: 62318 - protein, 420 aa, Homo sapiens
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFNQLPAVLGAQGFGAGRHCWEVETADAASCRDSSGEDADDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 62319 - protein, 420 aa, Homo sapiens; identical to SEQ ID NO: 62306

SEQ ID NO: 62320 - protein, 354 aa, Homo sapiens; identical to SEQ ID NO: 62309

SEQ ID NO: 62321 - protein, 420 aa, Homo sapiens; identical to SEQ ID NO: 62306

SEQ ID NO: 62322 - protein, 354 aa, Homo sapiens; identical to SEQ ID NO: 62309

SEQ ID NO: 62323 - protein, 251 aa, Homo sapiens; identical to SEQ ID NO: 62307

SEQ ID NO: 62324 - protein, 251 aa, Homo sapiens; identical to SEQ ID NO: 62307

SEQ ID NO: 62325 - protein, 251 aa, Homo sapiens; identical to SEQ ID NO: 62307

SEQ ID NO: 62326 - protein, 251 aa, Homo sapiens; identical to SEQ ID NO: 62307

SEQ ID NO: 62327 - protein, 251 aa, Homo sapiens; identical to SEQ ID NO: 62307

SEQ ID NO: 62328 - protein, 251 aa, Homo sapiens
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELLFGGGIPHSFLGTHSHAHCRSINSNPHFRPKIMRPHLVSTFPRPCSKPNPFLPSGSQNLLSPTAATVLPDFSHSNHSRPAMGNRPSPSVLVK

SEQ ID NO: 62329 - protein, 251 aa, Homo sapiens
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELLFGRGIPHSFLGTHSHAHCRSINSNPHFRPKIMRPHLVSTFPHPCSKPNPFLPSGSQNLLSPTATTVLPDFSHSNHSRPAMGNRPSPSVLVK

SEQ ID NO: 62330 - protein, 190 aa, Homo sapiens
MSTRKRRGGAINSRQAQKRTREATSTPEISLEAEPIELVETAGDEIVDLTCESLEPVVVDLTHNDSVVIVDERRRPRRNARRLPQDHADSCVVSSDDEELSRDRDVYVTTHTPRNARDEGATGLRPSGTVSCPICMDGYSEIVQNGRLIVSTECGHVFCSQCLRDSLKNANTCPTCRKKINHKRYHPIYI

SEQ ID NO: 62331 - protein, 5 aa, Homo sapiens
MSTRK

SEQ ID NO: 62332 - protein, 190 aa, Homo sapiens; identical to SEQ ID NO: 62330

SEQ ID NO: 62333 - protein, 190 aa, Homo sapiens; identical to SEQ ID NO: 62330

SEQ ID NO: 62334 - protein, 54 aa, Homo sapiens
MSTRKRRGGAINSRQAQKRTREATSTPEISLEAEPIELVETAGDEIVDLTCESL

SEQ ID NO: 62335 - protein, 114 aa, Homo sapiens
MSTRKRRGGAINSRQAQKRTREATSTPEISLEAEPIELVETAGDEIVDLTCESLEPVVVDLTHNDSVVVSVGVPQVLSVVPSAWTDTQRSCRMDVSSFPQNAAMSSVASASVIP

SEQ ID NO: 62336 - protein, 190 aa, Homo sapiens
MSTRKRRGGAINSRQAQKRTREATSTPEISLEAEPIELVETAGDEIVDLTCESLEPVVVDLTHNDSVVVSDERRRPRRNARRLPQDHADSCVVSSDDEELSRDRDVYVTTHTPRNARDEGATGLRPSGTVSCPICMDGYSEIVQNGRLIVSTECGHVFCSQCLRDSLKNANTCPTCRKKINHKRYHPIYI

SEQ ID NO: 62337 - protein, 113 aa, Homo sapiens
MSTRKRRGGAINSRQAQKRTREATSTPEISLEAEPIELVETAGDEIVDLTCESLEPVVVDLTHNDSVVIVDGPQVLSVVPSAWTDTQRSCRMDVSSFPQNAAMSSVASASVIP

SEQ ID NO: 62338 - protein, 783 aa, Homo sapiens
MSGGHQLQLAALWPWLLMATLQAGFGRTGLVLAAAVESERSAEQKAIIRVIPLKMDPTGKLNLTLEGVFAGVAEITPAEGKLMQSHPLYLCNASDDDNLEPGFISIVKLESPRRAPRPCLSLASKARMAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 62339 - protein, 742 aa, Homo sapiens
MSGGHQLQLAALWPWLLMATLQAGFGRTGLVLAAAVESERSAEQKAIIRVIPLKMDPTGKLNLTLEGVFAGVAEITPAEGKLMQARMAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 62340 - protein, 180 aa, Homo sapiens
MAAAEEEDGGPEGPNRERGGAGATFECNICLETAREAVVSVCGHLYCWPCLHQWLETRPERQECPVCKAGISREKVVPLYGRGSQKPQDPRLKTPPRPQGQRPAPESRGGFQPFGDTGGFHFSFGVGAFPFGFFTTVFNAHEPFRRGTGVDLGQGHPASSWQDSLFLFLAIFFFFWLLSI

SEQ ID NO: 62341 - protein, 180 aa, Homo sapiens; identical to SEQ ID NO: 62340

SEQ ID NO: 62342 - protein, 182 aa, Homo sapiens
MAAAEEEDGGPEGPNRERGGAGATFECNICLETAREAVVSVCGHLYCWPCLHQWLETRPERQECPVCKAGISREKVVPLYGRGSQKPQDPRLKTPPRPQGQRPAPESRGGFQPFGDTGGFHFSFGVGAFPFGFFTTVFNAHEPFRRGTGPFSTSPAFFHYLIGNTSREFRGRIYNFWLPRNL

SEQ ID NO: 62343 - protein, 180 aa, Homo sapiens; identical to SEQ ID NO: 62340

SEQ ID NO: 62344 - protein, 180 aa, Homo sapiens; identical to SEQ ID NO: 62340

SEQ ID NO: 62345 - protein, 180 aa, Homo sapiens; identical to SEQ ID NO: 62340

SEQ ID NO: 62346 - protein, 180 aa, Homo sapiens; identical to SEQ ID NO: 62340

SEQ ID NO: 62347 - protein, 180 aa, Homo sapiens; identical to SEQ ID NO: 62340

SEQ ID NO: 62348 - protein, 182 aa, Homo sapiens; identical to SEQ ID NO: 62342

SEQ ID NO: 62349 - protein, 182 aa, Homo sapiens; identical to SEQ ID NO: 62342

SEQ ID NO: 62350 - protein, 182 aa, Homo sapiens; identical to SEQ ID NO: 62342

SEQ ID NO: 62351 - protein, 182 aa, Homo sapiens; identical to SEQ ID NO: 62342

SEQ ID NO: 62352 - protein, 182 aa, Homo sapiens; identical to SEQ ID NO: 62342

SEQ ID NO: 62353 - protein, 182 aa, Homo sapiens; identical to SEQ ID NO: 62342

SEQ ID NO: 62354 - protein, 113 aa, Homo sapiens
MADVEDGEETCALASHSGSSGSKSGGDKMFSLKKWNAVAMWSWDVECDTCAICRVQVMDACLRCQAENKQEDCVVVWGECNHSFHNCCMSLWVKQNNRCPLCQQDWVVQRIGK

SEQ ID NO: 62355 - protein, 90 aa, Homo sapiens
MADVEDGEETCALASHSGSSGSKSGGDKMFSLKKWNAVAMWSWDVECDTCAICRVQMPVLDVKLKTNKRTVLWSGENVIIPSTTAACPCG

SEQ ID NO: 62356 - protein, 97 aa, Homo sapiens
MADVEDGEETCALASHSGSSGSKSGGDKMFSLKKWNAVAMWSWDVECDTCAICRVQVMVVWGECNHSFHNCCMSLWVKQNNRCPLCQQDWVVQRIGK

SEQ ID NO: 62357 - protein, 624 aa, Homo sapiens
MENSDSNDKGSGDQSAAQRRSQMDRLDREEAFYQFVNNLSEEDYRLMRDNNLLGTPGESTEEELLRRLQQIKEGPPPQNSDENRGGDSSDDVSNGDSIIDWLNSVRQTGNTTRSGQRGNQSWRAVSRTNPNSGDFRFSLEINVNRNNGSQNSENENEPSARRSSGENVENNSQRQVENPRSESTSARPSRSERNSTEALTEVPPTRGQRRARSRSPDHRRTRARAERSRSPLHPMSEIPRRSHHSISSQTFEHPLVNETEGSSRTRHHVTLRQQISGPELLSRGLFAASGTRNASQGAGSSDTAASGESTGSGQRPPTIVLDLQVRRVRPGEYRQRDSIASRTRSRSQTPNNTVTYESERGGFRRTFSRSERAGVRTYVSTIRIPIRRILNTGLSETTSVAIQTMLRQIMTGFGELSYFMYSDSDSEPTGSVSNRNMERAESRSGRGGSGGGSSSGSSSSSSSSSSSSSSSSSSSSPSSSSGGESSETSSDLFEGSNEGSSSSGSSGARREGRHRAPVTFDESGSLPFLSLAQFFLLNEDDDDQPRGLTKEQIDNLAMRSFGENDALKTCSVCITEYTEGNKLRKLPCSHEYHVHCIDRWLSENSTCPICRRAVLASGNRESVV

SEQ ID NO: 62358 - protein, 624 aa, Homo sapiens; identical to SEQ ID NO: 62357

SEQ ID NO: 62359 - protein, 317 aa, Homo sapiens
  MOD_RES (1)..(1): Any amino acid
XLPAPAAALPGAPPPPPGVRGYPARARGLQGASGGARFPSSLSLPVPGKGGWVVSRAKFPALDSCEITTAHPRLCFAVSPPFSCSLPLPSLFPHSPLLGRPKRQAKPAADEGFWDCSVCTFRNSAEAFKCSICDVRKGTSTRKPRINSQLVAQQVAQQYATPPPPKKEKKEKVEKQDKEKPEKDKEISPSVTKKNTNKKTKPKSDILKDPPSEANSIQSANATTKTSETNHTSRPRLKNVDRSTAQQLAVTVGNVTVIITDFKEKTRSSSTSSSTVTSSAGSEQQNQSSSGSESTDKGSSRSSTPKGDMSAVNDESF

SEQ ID NO: 62360 - protein, 151 aa, Homo sapiens
MDSAACAAAATPVPALALALAPDLAQAPLALPGLLSPSCLLSSGQEVNGSERGTCLWRPWLSSTNDSPRQMRKLVDLAAGGATAAEVTKAESKFHHPVRLFWPKSRSFDYLYSAGEILLQNFPVQATINLYEDSDSEEEEEDEEQEDEEEK

SEQ ID NO: 62361 - protein, 104 aa, Homo sapiens
MDSAACAAAATPVPALALALAPDLAQAPLALPGLLSPSCLLSSGQEVNGSERLFWPKSRSFDYLYSAGEILLQNFPVQATINLYEDSDSEEEEEDEEQEDEEEK

SEQ ID NO: 62362 - protein, 70 aa, Homo sapiens
MPDGPGMTAASGKLYQFRHPVRLFWPKSKCYDYLYQEAEALLKNFPIQATISFYEDSDSEDEIEDLTCEN

SEQ ID NO: 62363 - protein, 128 aa, Homo sapiens
MENAGGAEGTESGAAACAATDGPTRRAGADSGYAGFWRPWVDAGGKKEEETPNHAAEAMPDGPGMTAASGKLYQFRHPVRLFWPKSKCYDYLYQEAEALLKNFPIQATISFYEDSDSEDEIEDLTCEN

SEQ ID NO: 62364 - protein, 147 aa, Homo sapiens
MAAAADSFSGGPAGVRLPRSPPLKVLAEQLRRDAEGGPGAWRLSRAAAGRGPLDLAAVWMQGRVVMADRGEARLRDPSGDFSVRGLERVPRGRPCLVPGKYVMVMGVVQACSPEPCLQAVKMTDLSDNPIHESMWELEVEDLHRNIP

SEQ ID NO: 62365 - protein, 84 aa, Homo sapiens
MKQTQVGSLFSLGIRNPEPGPVSGTAVPRQLAWKSGKYVMVMGVVQACSPEPCLQAVKMTDLSDNPIHESMWELEVEDLHRNIP

SEQ ID NO: 62366 - protein, 476 aa, Homo sapiens
MANSAKAEEYEKMSLEQAKASVNSETESSFNINENTTASGTGLSEKTSVCRQVDIARKRKEFEDDLVKESSSCGKDTPSKKRKLDPEIVPEEKDCGDAEGNSKKRKRETEDVPKDKSSTGDGTQNKRKIALEDVPEKQKNLEEGHSSTVAAHYNELQEVGLEKRSQSRIFYLRNFNNWMKSVLIGEFLEKVRQKKKRDITVLDLGCGKGGDLLKWKKGRINKLVCTDIADVSVKQCQQRYEDMKNRRDSEYIFSAEFITADSSKELLIDKFRDPQMCFDICSCQFVCHYSFESYEQADMMLRNACERLSPGGYFIGTTPNSFELIRRLEASETESFGNEIYTVKFQKKGDYPLFGCKYDFNLEGVVDVPEFLVYFPLLNEMAKKYNMKLVYKKTFLEFYEEKIKNNENKMLLKRMQALEPYPANESSKLVSEKVDDYEHAAKYMKNSQVRLPLGTLSKSEWEATSIYLVFAFEKQQ

SEQ ID NO: 62367 - protein, 476 aa, Homo sapiens; identical to SEQ ID NO: 62366

SEQ ID NO: 62368 - protein, 234 aa, Homo sapiens [sequence omitted]

SEQ ID NO: 62369 - protein, 476 aa, Homo sapiens; identical to SEQ ID NO: 62366

SEQ ID NO: 62370 - protein, 129 aa, Homo sapiens [sequence omitted]

SEQ ID NO: 62371 - protein, 155 aa, Homo sapiens
MAPRTWCPAGIFGLFCPLTLACSSLTIALTDCQPIILVSPTLSLWMVVRSVWIMQASLLGEPEEVALGPMGVVAATLEVVGTRAMGVAGIMTVDLEGMDMDMDVPETIMAETRVVMTATQEEITETIMTTEMRHAHNIGETWISALSEPVCHTLS

SEQ ID NO: 62372 - protein, 157 aa, Homo sapiens
MSSEEGKLFVGGLNFNTDEQALEDHFSSFGPISEVVVVKDRETQRSRGFGFITFTNPEHASVAMRAMNGESLDGRQIRVDHAGKSARGTRGGGFGAHGRGRSYSRGGGDQGYGSGRYYDSRPGGYGYGYGRSRDYNGRNQGGYDRYSGGNYRDNYDN

SEQ ID NO: 62373 - protein, 157 aa, Homo sapiens; identical to SEQ ID NO: 62372

SEQ ID NO: 62374 - protein, 169 aa, Homo sapiens
MAPRTWCPAGIFGLFCPLTLACSSLTIALTDCQPIILVSPTLSLWMVVRSVWIMQASLLGEPEEVALGPMGVVAATLEVVGTRAMGVAGIMTVDLEGMDMDMDVPETIMAETRVVMTATQEEITETIMTTEMRHAHNIDTQGIISDPGSSFQMAVFIKVFGAAPKHLIL

SEQ ID NO: 62375 - protein, 852 aa, Homo sapiens
MEYERRGGRGDRTGRYGATDRSQDDGGENRSRDHDYRDMDYRSYPREYGSQEGKHDYDDSSEEQSAEIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 62376 - protein, 853 aa, Homo sapiens
MEYERRGGRGDRTGRYGATDRSQDDGGENRSRDHDYRDMDYRSYPREYGSQEGKHDYDDSSEEQSAEIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 62377 - protein, 930 aa, Homo sapiens
MEYERRGGRGDRTGRYGATDRSQDDGGENRSRDHDYRDMDYRSYPREYGSQEGKHDYDDSSEEQSAEDSYEASPGSETQRRRRRRHRHSPTGPPGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 62378 - protein, 669 aa, Homo sapiens
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSLNSYGAQGSSLASYGNQPSSYGAQAASSYGVRAAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYGSDRRLAELSDYRRLSESQLSFRRSPTKSSLDYRRLPDAHSDYARYSGSYNDYLRAAQMHSGYQRRM

SEQ ID NO: 62379 - protein, 156 aa, Homo sapiens
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGMVPTGV

SEQ ID NO: 62380 - protein, 119 aa, Homo sapiens
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKGMVPTGV

SEQ ID NO: 62381 - protein, 977 aa, Homo sapiens
MRTAGRDPVPRRSPRWRRAVPLCETSAGRRVTQLRGDDLRRPATMKGKERSPVKAKRSRGGEDSTSRGERSKKLGGSGGSNGSSSGKTDSGGGSRRSLHLDKSSSRGGSREYDTGGGSSSSRLHSYSSPSTKNSSGGGESRSSSRGGGGESRSSGAASSAPGGGDGAEYKTLKISELGSQLSDEAVEDGLFHEFKRFGDVSVKISHLSGSGSGDERVAFVNFRRPEDARAAKHARGRLVLYDRPLKIEAVYVSRRRSRSPLDKDTYPPSASVVGASVGGHRHPPGGGGGQRSLSPGGAALGYRDYRLQQLALGRLPPPPPPPLPRDLERERDYPFYERVRPAYSLEPRVGAGAGAAPFREVDEISPEDDQRANRTLFLGNLDITVTESDLRRAFDRFGVITEVDIKRPSRGQTSTYGFLKFENLDMSHRAKLAMSGKIIIRNPIKIGYGKATPTTRLWVGGLGPWVPLAALAREFDRFGTIRTIDYRKGDSWAYIQYESLDAAHAAWTHMRGFPLGGPDRRLRVDFADTEHRYQQQYLQPLPLTHYELVTDAFGHRAPDPLRGARDRTPPLLYRDRDRDLYPDSDWVPPPPPVRERSTRTAATSVPAYEPLDSLDRRRDGWSLDRDRGDRDLPSSRDQPRKRRLPEESGGRHLDRSPESDRPRKRHCAPSPDRSPELSSSRDRYNSDNDRSSRLLLERPSPIRDRRGSLEKSQGDKRDRKNSASAERDRKHRTTAPTEGKSPLKKEDRSDGSAPSTSTASSKLKSPSQKQDGGTAPVASASPKLCLAWQGMLLLKNSNFPSNMHLLQGDLQVASSLLVEGSTGGKVAQLKITQRLRLDQPKLDEVTRRIKVAGPNGYAILLAVPGSSDSRSSSSSAASDTATSTQRPLRNLVSYLKQKQAAGVISLPVGGNKDKENTGVLHAFPPCEFSQQFLDSPAKALAKSEEDYLVMIIVRGFGFQIGVRYENKKRENLALTLL

SEQ ID NO: 62382 - protein, 890 aa, Homo sapiens
MKRQSERDSSPSGRGSSSSAKRPREREREAEAGGRRAAHKASGGAKHPVPARARDKPRGSGSGGGGHRDGRGTGDANHRASSGRSSGSGAGGGGRGGKASGDPGASGMSPRASPLPPPPPPPGAEPACPGSSAAAPEYKTLLISSLSPALPAEHLEDRLFHQFKRFGEISLRLSHTPELGRVAYVNFRHPQDAREARQHALARQLLLYDRPLKVEPVYLRGGGGSSRRSSSSSAAASTPPPGPPAPADPLGYLPLHGGYQYKQRSLSPVAAPPLREPRARHAAAAFALDAAAAAAVGLSRERALDYYGLYDDRGRPYGYPAVCEEDLMPEDDQRATRNLFIGNLDHSVSEVELRRAFEKYGIIEEVVIKRPARGQGGAYAFLKFQNLDMAHRAKVAMSGRVIGRNPIKIGYGKANPTTRLWVGGLGPNTSLAALAREFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAGVISLPVGGSKGRDGTGMLYAFPPCDFSQQYLQSALRTLGKLEEEHMVIVIVRDTA

SEQ ID NO: 62383 - protein, 254 aa, Homo sapiens
METVVCPPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAG

SEQ ID NO: 62384 - protein, 211 aa, Homo sapiens [sequence omitted]

SEQ ID NO: 62385 - protein, 563 aa, Homo sapiens
MPEDDQRATRNLFIGNLDHSVSEVELRRAFEKYGIIEEVVIKRPARGQGGAYAFLKFQNLDMAHRAKVAMSGRVIGRNPIKIGYGKANPTTRLWVGGLGPNTSLAALAREFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAGVISLPVGGSKGRDGTGMLYAFPPCDFSQQYLQSALRTLGKLEEEHMVIVIVRDTA

SEQ ID NO: 62386 - protein, 243 aa, Homo sapiens
MGRVGRAGRSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGG

SEQ ID NO: 62387 - protein, 401 aa, Homo sapiens
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGGKIIVGDATEKDASKKSDSNPLTEILKCPTKVVLLRNMVGAGEVDEDLEVETKEECEKYGKVGKCVIFEIPGAPDDEAVRIFLEFERVESAIKAVVDLNGRYFGGRVVKACFYNLDKFRVLDLAEQV

SEQ ID NO: 62388 - protein, 212 aa, Homo sapiens
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPP

SEQ ID NO: 62389 - protein, 221 aa, Homo sapiens
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRKDRHEASGFARRPDPDSDEDEDYERERRKRSMGGAAIAPPTSLVEKDKELPRDFPYEEDSRPRSQSSKAAIPPPVYEEQDRPRS

SEQ ID NO: 62390 - protein, 243 aa, Homo sapiens; identical to SEQ ID NO: 62386

SEQ ID NO: 62391 - protein, 401 aa, Homo sapiens; identical to SEQ ID NO: 62387

SEQ ID NO: 62392 - protein, 225 aa, Homo sapiens
  MOD_RES (1)..(1): Any amino acid
XPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGGKIIVGDATEKGVSPGKRVTRGKGLAPSISDMASLDPHVSAGGQ

SEQ ID NO: 62393 - protein, 1227 aa, Homo sapiens
MVLAAAMSQDADPSGPEQPDRVACSVPGARASPAPSGPRGMQQPPPPPQPPPPPQAGLPQIIQNAAKLLDKNPFSVSNPNPLLPSPASLQLAQLQAQLTLHRLKLAQTAVTNNTAAATVLNQVLSKVAMSQPLFNQLRHPSVITGPHGHAGVPQHAAAIPSTRFPSNAIAFSPPSQTRGPGPSMNLPNQPPSAMVMHPFTGVMPQTPGQPAVILGIGKTGPAPATAGFYEYGKASSGQTYGPETDGQPGFLPSSASTSGSVTYEGHYSHTGQDGQAAFSKDFYGPNSQGSHVASGFPAEQAGGLKSEVGPLLQGTNSQWESPHGFSGQSKPDLTAGPMWPPPHNQPYELYDPEEPTSDRTPPSFGGRLNNSKQGFIGAGRRAKEDQALLSVRPLQAHELNDFHGVAPLHLPHICSICDKKVFDLKDWELHVKGKLHAQKCLVFSENAGIRCILGSAEGTLCASPNSTAVYNPAGNEDYASNLGTSYVPIPARSFTQSSPTFPLASVGTTFAQRKGAGRVVHICNLPEGSCTENDVINLGLPFGKVTNYILMKSTNQAFLEMAYTEAAQAMVQYYQEKSAVINGEKLLIRMSKRYKELQLKKPGKAVAAIIQDIHSQRERDMFREADRYGPERPRSRSPVSRSLSPRSHTPSFTSCSSSHSPPGPSRADWGNGRDSWEHSPYARREEERDPAPWRDNGDDKRDRMDPWAHDRKHHPRQLDKAELDERPEGGRPHREKYPRSGSPNLPHSVSSYKSREDGYYRKEPKAKWDKYLKQQQDAPGRSRRKDEARLRESRHPHPDDSGKEDGLGPKVTRAPEGAKAKQNEKNKTKRTDRDQEGADDRKENTMAENEAGKEEQEGMEESPQSVGRQEKEAEFSDPENTRTKKEQDWESESEAEGESWYPTNMEELVTVDEVGEEEDFIVEPDIPELEEIVPIDQKDKICPETCLCVTTTLDLDLAQDFPKEGVKAVGNGAAEISLKSPRELPSASTSCPSDMDVEMPGLNLDAERKPAESETGLSLEDSDCYEKEAKGVESSDVHPAPTVQQMSSPKPAEERARQPSPFVDDCKTRGTPEDGACEGSPLEEKASPPIETDLQNQACQEVLTPENSRYVEMKSLEVRSPEYTEVELKQPLSLPSWEPEDVFSELSIPLGVEFVVPRTGFYCKLCGLFYTSEETAKMSHCRSAVHYRNLQKYLSQLAEEGLKETEGADSPRPEDSGIVPRFERKKL

SEQ ID NO: 62394 - protein, 1125 aa, Homo sapiens
MVLAAAMSQDADPSGPEQPDRVACSVPGARASPAPSGPRGMQQPPPPPQPPPPPQAGLPQIIQNAAKLLDKNPFSVSNPNPLLPSPASLQLAQLQAQLTLHRLKLAQTAVTNNTAAATVLNQVLSKVAMSQPLFNQLRHPSVITGPHGHAGVPQHAAAIPSTRFPSNAIAFSPPSQTRGPGPSMNLPNQPPSAMVMHPFTGVMPQTPGQPAVILGIGKTGPAPATAGFYEYGKASSGQTYGPETDGQPGFLPSSASTSGSVTYEGHYSHTGQDGQAAFSKDFYGPNSQGSHVASGFPAEQAGGLKSEVGPLLQGTNSQWESPHGFSGQSKPDLTAGPMWPPPHNQPYELYDPEEPTSDRTPPSFGGRLNNSKQGFIGAGRRAKEDQALLSVRPLQAHELNDFHGVAPLHLPHICSICDKKVFDLKDWELHVKGKLHAQKCLVFSENAGIRCILGSAEGTLCASPNSTAVYNPAGNEDYASNLGTSYVPIPARSFTQSSPTFPLASVGTTFAQRKGAGRVVHICNLPEGSCTENDVINLGLPFGKVTNYILMKSTNQAFLEMAYTEAAQAMVQYYQEKSAVINGEKLLIRMSKRYKELQLKKPGKAVAAIIQDIHSQRERDMFREADRYGPERPRSRSPVSRSLSPRSHTPSFTSCSSSHSPPGPSRADWGNGRDSWEHSPYARREEERDPAPWRDNGDDKRDRMDPWAHDRKHHPRQLDKAELDERPEGGRPHREKYPRSGSPNLPHSVSSYKSREDGYYRKEPKAKWDKYLKQQQDAPGRSRRKDEARLRESRHPHPDDSGKEDGLGPKVTRAPEGAKAKQNEKNKTKRTDRDQEGADDRKENTMAENEAGKEEQEGMEESPQSVGRQEKEAEFSDPENTRTKKEQDWESESEAEGESWYPTNMEELVTVDEVGEEEDFIVEPDIPELEEIVPIDQKDKICPETCLCVTTTLDLDLAQDFPKEGVKAVGNGAAEISLKSPRELPSASTSCPSDMDVEMPGLNLDAERKPAESETGLSLEDSDCYEKEAKGVESSDVHPAPTVQQMSSPKPAEERARQPSPFVDDCKTRGTPEDGACEGSPLEEKASPPIETDLQNQACQGSDSDTRLVSGYSLTPLEKTPGTWK

SEQ ID NO: 62395 - protein, 420 aa, Homo sapiens
MATSLGSNTYNRQNWEDADFPILCQTCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 62396 - protein, 371 aa, Homo sapiens
MATSLGSNTYNRQNWEDADFPILCQTCLGENPYIRMTKEKYGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 62397 - protein, 371 aa, Homo sapiens
MATSLGSNTYNRQNWEDADFPILCQTCLGENPYIRMEREKSGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 62398 - protein, 843 aa, Homo sapiens
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 62399 - protein, 127 aa, Homo sapiens
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQ

SEQ ID NO: 62400 - protein, 300 aa, Homo sapiens
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKVVFLSFHLIPI

SEQ ID NO: 62401 - protein, 294 aa, Homo sapiens
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKRSYGD

SEQ ID NO: 62402 - protein, 843 aa, Homo sapiens; identical to SEQ ID NO: 62398

SEQ ID NO: 62403 - protein, 243 aa, Homo sapiens
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKED

SEQ ID NO: 62404 - protein, 294 aa, Homo sapiens; identical to SEQ ID NO: 62401

SEQ ID NO: 62405 - protein, 759 aa, Homo sapiens
MAGLTLFVGRLPPSARSEQLEELFSQVGPVKQCFVVTEKGSKACRGFGYVTFSMLEDVQRALKEITTFEGCKINVTVAKKKLRNKTKEKGKNENSECPKKEPKAKKAKVADKKARLIIRNLSFKCSEDDLKTVFAQFGAVLEVNIPRKPDGKMRGFGFVQFKNLLEAGKALKGMNMKEIKGRTVAVDWAVAKDKYKDTQSVSAIGEEKSHESKHQESVKKKGREEEDMEEEENDDDDDDDDEEDGVFDDEDEEEENIESKVTKPVQIQKRAVKRPAPAKSSDHSEEDSDLEESDSIDDGEELAQSDTSTEEQEDKAVQVSNKKKRKLPSDVNEGKTVFIRNLSFDSEEEELGELLQQFGELKYVRIVLHPDTEHSKGCAFAQFMTQEAAQKCLLAASPENEAGGLKLDGRQLKVDLAVTRDEAAKLQTTKVKKPTGTRNLYLAREGLIRAGTKAAEGVSAADMAKRERFELLKHQKLKDQNIFVSRTRLCLHNLPKAVDDKQLRKLLLSATSGEKGVRIKECRVMRDLKGVHGNMKGQSLGYAFAEFQEHEHALKALRLINNNPEIFGPLKRPIVEFSLEDRRKLKMKELRIQRSLQKMRSKPATGEPQKGQPEPAKDQQQKAAQHHTEEQSKVPPEQKRKAGSTSWTGFQTKAEVEQVELPDGKKRRKVLALPSHRGPKIRLRDKGKVKPVHPKKPKPQINQWKQEKQQLSSEQVSRKKAKGNKTETRFNQLVEQYKQKLLGPSKGAPLAKRSKWFDS

SEQ ID NO: 62406 - protein, 618 aa, Homo sapiens
MAGLTLFVGRLPPSARSEQLEELFSQVGPVKQCFVVTEKGRTVAVDWAVAKDKYKDTQSVSAIGEEKSHESKHQESVKKKGREEEDMEEEENDDDDDDDDEEDGVFDDEDEEEENIESKVTKPVQIQKRAVKRPAPAKSSDHSEEDSDLEESDSIDDGEELAQSDTSTEEQEDKAVQVSNKKKRKLPSDVNEGKTVFIRNLSFDSEEEELGELLQQFGELKYVRIVLHPDTEHSKGCAFAQFMTQEAAQKCLLAASPENEAGGLKLDGRQLKVDLAVTRDEAAKLQTTKVKKPTGTRNLYLAREGLIRAGTKAAEGVSAADMAKRERFELLKHQKLKDQNIFVSRTRLCLHNLPKAVDDKQLRKLLLSATSGEKGVRIKECRVMRDLKGVHGNMKGQSLGYAFAEFQEHEHALKALRLINNNPEIFGPLKRPIVEFSLEDRRKLKMKELRIQRSLQKMRSKPATGEPQKGQPEPAKDQQQKAAQHHTEEQSKVPPEQKRKAGSTSWTGFQTKAEVEQVELPDGKKRRKVLALPSHRGPKIRLRDKGKVKPVHPKKPKPQINQWKQEKQQLSSEQVSRKKAKGNKTETRFNQLVEQYKQKLLGPSKGAPLAKRSKWFDS

SEQ ID NO: 62407 - protein, 239 aa, Homo sapiens
MLLQPAPCAPSAGFPRPLAAPGAMHGSQKDTTFTKIFVGGLPYHTTDASLRKYFEGFGDIEEAVVITDRQTGKSRGYGFVTMADRAAAERACKDPNPIIDGRKANVNLAYLGAKPRSLQTGFAIGVQQLHPTLIQRTYGLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 62408 - protein, 158 aa, Homo sapiens
MADRAAAERACKDPNPIIDGRKANVNLAYLGAKPRSLQTGFAIGVQQLHPTLIQRTYGLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 62409 - protein, 121 aa, Homo sapiens
MLLQPAPCAPSAGFPRPLAAPGAMHGSQKDTTFTKIFVGGLPYHTTDASLRKYFEGFGDIEEAVVITDRQTGKSRGYGFVTMADRAAAERACKDPNPIIDGRKANVNLAYLGAKPRSLQTG

SEQ ID NO: 62410 - protein, 364 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 62411 - protein, 364 aa, Homo sapiens; identical to SEQ ID NO: 62410

SEQ ID NO: 62412 - protein, 364 aa, Homo sapiens; identical to SEQ ID NO: 62410

SEQ ID NO: 62413 - protein, 177 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGEPPSLGRGLNTRLCAENGWISKRRGLVKITAVGWLVMKK

SEQ ID NO: 62414 - protein, 177 aa, Homo sapiens; identical to SEQ ID NO: 62413

SEQ ID NO: 62415 - protein, 173 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKITPVTEGYCCCNKGHTYIFKNCNLILESRKSRRC

SEQ ID NO: 62416 - protein, 143 aa, Homo sapiens
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGGMCVG

SEQ ID NO: 62417 - protein, 480 aa, Homo sapiens
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARAAAAATVVPPMVGGPPFVGPVGFGPGDRSHLDSPEAREAMFLRRAAVAPQRAPILRPAFVPHVLQRADSALSSAAAGPRPMALRPPHQALVGPPLPGPPGPPMMLPPMARAPGPPLGSMAALRPPLEEPAAPRELGLGLGLGLKEKEEAVVAAAAGLEEASAAVAVGAGGAPAGPAVIGPSLPLALAMPLPEPEPLPLPLEVVRGLLPPLRIPELLSLRPRPRPPRPEPPPGLMALEVPEPLGEDKKKGKPEKLKRCIRTAAGSSWEDPSLLEWDADDFRIFCGDLGNEVNDDILARAFSRFPSFLKAKVIRDKRTGKTKGYGFVSFKDPSDYVRAMREMNGKYVGSRPIKLRKSMWKDRNLDVVRKKQKEKKKLGLR

SEQ ID NO: 62418 - protein, 451 aa, Homo sapiens
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARAAAAATVVPPMVGGPPFVGPVGFGPGDRSHLDSPEAREAMFLRRAAAGPRPMALRPPHQALVGPPLPGPPGPPMMLPPMARAPGPPLGSMAALRPPLEEPAAPRELGLGLGLGLKEKEEAVVAAAAGLEEASAAVAVGAGGAPAGPAVIGPSLPLALAMPLPEPEPLPLPLEVVRGLLPPLRIPELLSLRPRPRPPRPEPPPGLMALEVPEPLGEDKKKGKPEKLKRCIRTAAGSSWEDPSLLEWDADDFRIFCGDLGNEVNDDILARAFSRFPSFLKAKVIRDKRTGKTKGYGFVSFKDPSDYVRAMREMNGKYVGSRPIKLRKSMWKDRNLDVVRKKQKEKKKLGLR

SEQ ID NO: 62419 - protein, 266 aa, Homo sapiens
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSRYERTMDNMTSSAQIIQRSFSSPENFQRQAVMNSALRQMSYGGKFGSSPLDQSGFSPSVQSHSHSFNQSSSSQWRQGTPSSQRKVRMNSYPYLADRHYSREQRYTDHGSDHHYRGKRDDFFYEDRNHDDWSHDYDNRRDSSRDGKWRSSRH

SEQ ID NO: 62420 - protein, 174 aa, Homo sapiens
MADVLDLHEAGGEDFAMDEDGDESIHKLKEKAKKRKGRGFGSEEGSRARMREDYDSVEQDGDEPGPQRSVEGWILFVTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 62421 - protein, 173 aa, Homo sapiens
MADVLDLHEAGGEDFAMDEDGDESIHKLKEKAKKRKGRGFGSEGSRARMREDYDSVEQDGDEPGPQRSVEGWILFVTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 62422 - protein, 392 aa, Homo sapiens
MVEADRPGKLFIGGLNLETDEKALEAEFGKYGRIVEVLLMKDRETNKSRGFAFVTFESPADAKAAARDMNGKSLDGKAIKVAQATKPAFESSRRGPPPPRSRGRPRFLRGTRGGGGGPRRSPSRGGPDDDGGYTADFDLRPSRAPMPMKRGPPPRRVGPPPKRAAPSGPARSSGGGMRGRALAVRGRDGYSGPPRREPLPPRRDPYLGPRDEGYSSRDGYSSRDYREPRGFAPSPGEYTHRDYGHSSVRDDCPLRGYSDRDGYGGRDRDYGDHLSRGSHREPFESYGELRGAAPGRGTPPSYGGGGRYEEYRGYSPDAYSGGRDSYSSSYGRSDRYSRGRHRVGRPDRGLSLSMERGCPPQRDSYSRSGCRVPRGGGRLGGRLERGGGRSRY

SEQ ID NO: 62423 - protein, 496 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 62424 - protein, 496 aa, Homo sapiens; identical to SEQ ID NO: 62423

SEQ ID NO: 62425 - protein, 289 aa, Homo sapiens
MSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 62426 - protein, 421 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSKP

SEQ ID NO: 62427 - protein, 420 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSK

SEQ ID NO: 62428 - protein, 419 aa, Homo sapiens
MGKRLDQPQMYPQYTYYYPHYLQTKSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 62429 - protein, 437 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 62430 - protein, 434 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEVLRGRTVPRQNREAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSKP

SEQ ID NO: 62431 - protein, 436 aa, Homo sapiens
MGKRLDQPQMYPQYTYYYPHYLQTKSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 62432 - protein, 433 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEVLRGRTVPRQNREAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSK

SEQ ID NO: 62433 - protein, 204 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQLCEGQTVRRSHPLSAPSPDSASLAWFPV

SEQ ID NO: 62434 - protein, 196 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQMRWLPPSEATSQGWKSRQFC

SEQ ID NO: 62435 - protein, 219 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQCFSPEAKPNTPVFCPLLQQIRFVSGNVFVTYQPTADQQRELPC

SEQ ID NO: 62436 - protein, 196 aa, Homo sapiens; identical to SEQ ID NO: 62434

SEQ ID NO: 62437 - protein, 153 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPLMRWLPPSEATSQGWKSRQFC

SEQ ID NO: 62438 - protein, 418 aa, Homo sapiens
MLASQGVLLHPYGVPMIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQEPVYGNKLLQGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 62439 - protein, 402 aa, Homo sapiens
MIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 62440 - protein, 391 aa, Homo sapiens
MLASQGVLLHPYGVPMIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAVPGFPYPAATAAAAYRGAHLRGRGRTVYNTFRAAAPPPPIPAYGGVVYQEPVYGNKLLQGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 62441 - protein, 395 aa, Homo sapiens
MLASQGVLLHPYGVPMIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQEPVYGNKLLQGGYAAYRYAQPTPATAAAYSDRNQFVFVAADEISCNTSAVTDEFMLPTPTTTHLLQPPPTALVP

SEQ ID NO: 62442 - protein, 392 aa, Homo sapiens
MLASQGVLLHPYGVPMIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQEPVYGNKLLQGGYAAYRYAQPTPATAAAYSDSYGRVYAADPYHHALAPAPTYGVGAMASIYRGGYNRFAPY

SEQ ID NO: 62443 - protein, 397 aa, Homo sapiens
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 62444 - protein, 466 aa, Homo sapiens
METGQRTHASGTYSFLDRTQHSDIKADCNTCVEIEDRKVSRQQMNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDRNQFVFVAADEISCNTSAVTDEFMLPTPTTTHLLQPPPTALVPCPKVPAPAQTSEELSCTLPGLCCQAAENLTASPPLLQFMFKVIVAQERK

SEQ ID NO: 62445 - protein, 397 aa, Homo sapiens; identical to SEQ ID NO: 62443

SEQ ID NO: 62446 - protein, 263 aa, Homo sapiens
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATA

SEQ ID NO: 62447 - protein, 370 aa, Homo sapiens
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAVPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 62448 - protein, 574 aa, Homo sapiens
MAHNKIPPRWLNCPRRGQPVAGRFLPLKTMLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKKYKPGRCDDILKWKPPSLNSVDFRLKITRMGGEGLLPQNVGLLYVGGYERPFAQIKVTKELKQYDNKIIECKFENNSWVFMRQRTDKSFPNAYNTAMAVCNSISNPVTKEMLFEFIDRCTAASQGQKRKHHLDPDTELMPPPPPKRPRPLT

SEQ ID NO: 62449 - protein, 541 aa, Homo sapiens
MAHNKIPPRWLNCPRRGQPVAGRFLPLKTMLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKLLEGNFAKEVSHEMDGLIFQPTGKYKPGRCDDILKWKPPSLNSVDFRLKITRMGGEGLLPQNVGLLYVGGYERPFAQIKVCLFIFSVLFLDVLLSRIHQNLANNNQHIKISCSSTLGG

SEQ ID NO: 62450 - protein, 597 aa, Homo sapiens
MAHNKIPPRWLNCPRRGQPVAGRFLPLKTMLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKLLEGNFAKEVSHEMDGLIFQPTGKYKPGRCDDILKWKPPSLNSVDFRLKITRMGGEGLLPQNVGLLYVGGYERPFAQIKVTKELKQYDNKIIECKFENNSWVFMRQRTDKSFPNAYNTAMAVCNSISNPVTKEMLFEFIDRCTAASQGQKRKHHLDPDTELMPPPPPKRPRPLT

SEQ ID NO: 62451 - protein, 568 aa, Homo sapiens
MLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKLLEGNFAKEVSHEMDGLIFQPTGKYKPGRCDDILKWKPPSLNSVDFRLKITRMGGEGLLPQNVGLLYVGGYERPFAQIKVTKELKQYDNKIIECKFENNSWVFMRQRTDKSFPNAYNTAMAVCNSISNPVTKEMLFEFIDRCTAASQGQKRKHHLDPDTELMPPPPPKRPRPLT

SEQ ID NO: 62452 - protein, 514 aa, Homo sapiens
MGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKKYKPGRCDDILKWKPPSLNSVDFRLKITRMGGEGLLPQNVGLLYVGGYERPFAQIKVTKELKQYDNKIIECKFENNSWVFMRQRTDKSFPNAYNTAMAVCNSISNPVTKEMLFEFIDRCTAASQGQKRKHHLDPDTELMPPPPPKRPRPLT

SEQ ID NO: 62453 - protein, 420 aa, Homo sapiens
MAALVRPARFVVRPLLQVVQAWDLDARRWVRALRRSPVKVVFPSGEVVEQKRAPGKQPRKAPSEASAQEQREKQPLEESASRAPSTWEESGLRYDKAYPGDRRLSSVMTIVKSRPFREKQGKILLEGRRLISDALKAGAVPKMFFFSRLEYLKELPVDKLKGVSLIKVKFEDIKDWSDLVTPQGIMGIFAKPDHVKMTYPKTQLQHSLPLLLICDNLRDPGNLGTILRSAAGAGCSKVLLTKGCVDAWEPKVLRAGMGAHFRMPIINNLEWETVPNYLPPDTRVYVADNCGLYAQAEMSNKASDHGWVCDQRVMKFHKYEEEEDVETGASQDWLPHVEVQSYDSDWTEAPAAVVIGGETYGVSLESLQLAESTGGKRLLIPVVPGVDSLNSAMAASILLFEGKRQLRGRAEDLSRDRSYH

SEQ ID NO: 62454 - protein, 1393 aa, Homo sapiens
MLSRPKPGESEVDLLHFQSQFLAAGAAPAVQLVKKGNRGGGDANSDRPPLQDHRDVVMLDNLPDLPPALVPSPPKRARPSPGHCLPEDEDPEERLRRHDQHITAVLTKIIERDTSSVAVNLPVPSGVAFPAVFLRSRDTQGKSATSGKRSIFAQEIAARRIAEAKGPSVGEVVPNVGPPEGAVTCETPTPRNQGCQLPGSSHSFQGPNLVTGKGLRDQEAEQEAQTIHEENIARLQAMAPEEILQEQQRLLAQLDPSLVAFLRSHSHTQEQTGETASEEQRPGGPSANVTKEEPLMSAFASEPRKRDKLEPEAPALALPVTPQKEWLHMDTVELEKLHWTQDLPPVRRQQTQERMQARFSLQGELLAPDVDLPTHLGLHHHGEEAERAGYSLQELFHLTRSQVSQQRALALHVLAQVISRAQAGEFGDRLAGSVLSLLLDAGFLFLLRFSLDDRVDGVIATAIRALRALLVAPGDEELLDSTFSWYHGALTFPLMPSQEDKEDEDEDEECPAGKAKRKSPEEESRPPPDLARHDVIKGLLATSLLPRLRYVLEVTYPGPAVVLDILAVLIRLARHSLESATRVLECPRLIETIVREFLPTSWSPVGAGPTPSLYKVPCATAMKLLRVLASAGRNIAARLLSSFDLRSRLCRIIAEAPQELALPPEEAEMLSTEALRLWAVAASYGQGGYLYRELYPVLMRALQVVPRELSTHPPQPLSMQRIASLLTLLTQLTLAAGSTPAETISDSAEASLSATPSLVTWTQVSGLQPLVEPCLRQTLKLLSRPEMWRAVGPVPVACLLFLGAYYQAWSQQPSSCPEDWLQDMQRLSEELLLPLLSQPTLGSLWDSLRHCSLLCNPLSCVPALEAPPSLVSLGCSGGCPRLSLAGSASPFPFLTALLSLLNTLAQIHKGLCGQLAAILAAPGLQNYFLQCVAPGAAPHLTPFSAWALRHEYHLQYLALALAQKAAALQPLPATHAALYHGMALALLSRLLPGSEYLTHELLLSCVFRLEFLPERTSGGPEAADFSDQLSLGSSRVPRCGQGTLLAQACQDLPSIRNCYLTHCSPARASLLASQALHRGELQRVPTLLLPMPTEPLLPTDWPFLPLIRLYHRASDTPSGLSPTDTMGTAMRVLQWVLVLESWRPQALWAVPPAARLARLMCVFLVDSELFRESPVQHLVAALLAQLCQPQVLPNLNLDCRLPGLTSFPDLYANFLDHFEAVSFGDHLFGALVLLPLQRRFSVTLRLALFGEHVGALRALSLPLTQLPVSLECYTVPPEDNLALLQLYFRTLVTGALRPRWCPVLYAVAVAHVNSFIFSQDPQSSDEVKAARRSMLQKTWLLADEGLRQHLLHYKLPNSTLPEGFELYSQLPPLRQHYLQRLTSTVLQNGVSET

SEQ ID NO: 62455 - protein, 612 aa, Homo sapiens
MADFAGPSSAGRKAGAPRCSRKAAGTKQTSTLKQEDASKRKAELEAAVRKKIEFERKALHIVEQLLEENITEEFLMECGRFITPAHYSDVVDERSIVKLCGYPLCQKKLGIVPKQKYKISTKTNKVYDITERKSFCSNFCYQASKFFEAQIPKTPVWVREEERHPDFQLLKEEQSGHSGEEVQLCSKAIKTSDIDNPSHFEKQYESSSSSTHSDSSSDNEQDFVSSILPGNRPNSTNIRPQLHQKSIMKKKAGHKANSKHKDKEQTVVDVTEQLGDCKLDSQEKDATCELPLQKVNTQSSSNSTLPERLKASENSESEYSRSEITLVGISKKSAEHFKRKFAKSNQVSRSVSSSVQVCPEVGKRNLLKVLKETLIEWKTEETLRFLYGQNYASVCLKPEASLVKEELDEDDIISDPDSHFPAWRESQNSLDESLPFRGSGTAIKPLPSYENLKKETEKLNLRIREFYRGRYVLGEETTKSQDSEEHDSTFPLIDSSSQNQIRKRIVLEKLSKVLPGLLVPLQITLGDIYTQLKNLVRTFRLTNRNIIHKPAEWTLIAMVLLSLLTPILGIQKHSQEGMVFTRFLDTLLEELHLKNEDLESLTIIFRTSCLPE

SEQ ID NO: 62456 - protein, 584 aa, Homo sapiens
MADFAGPSSAGRKAGAPRCSRKAAGTKQTSTLKQEDASKRKAELEAAVRKKIEFERKALHIVEQLLEENITEEFLMECGRFITPAHYSDVVDERSIVKLCGYPLCQKKLGIVPKQKYKISTKTNKVYDITERKSFCSNFCYQASKFFEAQIPKTPVWVREEERHPDFQLLKEEQSGHSGEEVQLCSKAIKTSDIDNPSHFEKQYESSSSSTHSDSSSDNEQDFVSSILPGNRPNSTNIRPQLHQKSIMKKKAGHKANSKHKDKEQTVVDVTEQLGDCKLDSQEKDATCELPLQKVNTQSSSNSTLPERLKASENSESEYSRSEITLVGISKKSAEHFKRKFAKSNQVSRSVSSSVQVCPEVGKRNLLKVLKETLIEWKTEETLRFLYGQNYASVCLKPEASLVKEELDEDDIISDPDSHFPAWRESQNSLDESLPFRGSGTAIKPLPSYENLKKETEKLNLRIREFYRGRYVLGEETTKSQDSEEHDSTFPLIDSSSQNQIRKRIVLEKLSKVLPGLLVPLQITLGDIYTQLKNLVRTFRLTNRNIIHKPAEWTLIAMVLLSFLLNVKTRIKTFMMIYFHLMNS

SEQ ID NO: 62457 - protein, 665 aa, Homo sapiens
MTSANKAIELQLQVKQNAEELQDFMRDLENWEKDIKQKDMELRRQNGVPEENLPPIRNGNFRKKKKGKAKESSKKTREENTKNRIKSYDYEAWAKLDVDRILDELDKDDSTHESLSQESESEEDGIHVDSQKALVLKEKGNKYFKQGKYDEAIDCYTKGMDADPYNPVLPTNRASAYFRLKKFAVAESDCNLAVALNRSYTKAYSRRGAARFALQKLEEAKKDYERVLELEPNNFEATNELRKISQALASKENSYPKEADIVIKSTEGERKQIEAQQNKQQAISEKDRGNGFFKEGKYERAIECYTRGIAADGANALLPANRAMAYLKIQKYEEAEKDCTQAILLDGSYSKAFARRGTARTFLGKLNEAKQDFETVLLLEPGNKQAVTELSKIKKELIEKGHWDDVFLDSTQRQNVVKPIDNPPHPGSTKPLKKVIIEETGNLIQTIDVPDSTTAAAPENNPINLANVIAATGTTSKKNSSQDDLFPTSDTPRAKVLKIEEVSDTSSLQPQASLKQDVCQSYSEKMPIEIEQKPAQFATTVLPPIPANSFQLESDFRQLKSSPDMLYQYLKQIEPSLYPKLFQKNLDPDVFNQIVKILHDFYIEKEKPLLIFEILQRLSELKRFDMAVMFMSETEKKIARALFNHIDKSGLKDSSVEELKKRYGG

SEQ ID NO: 62458 - protein, 631 aa, Homo sapiens
MTSANKAIELQLQVKQNAEELQDFMRDLENWEKDIKQKDMELRRQNGVPEENLPPIRNGNFRKKKKGKAKESSKKTREENTKNRIKSYDYEAWAKLDVDRILDELDKDDSTHESLSQESESEEDGIHVDSQKALVLKEKGNKYFKQGKYDEAIDCYTKGMDADPYNPVLPTNRASAYFRLKKFAVAESDCNLAVALNRSYTKAYSRRGAARFALQKLEEAKKDYERVLELEPNNFEATNELRKISQALASKENSYPKEADIVIKSTEGERKQIEAQQNKQQAISEKDRGNGFFKEGKYERAIECYTRGIAADGANALLPANRAMAYLKIQKYEEAEKDCTQAILLDGSYSKAFARRGTARTFLGKLNEAKQDFETVLLLEPGNKQAVTELSKIKKKPLKKVIIEETGNLIQTIDVPDSTTAAAPENNPINLANVIAATGTTSKKNSSQDDLFPTSDTPRAKVLKIEEVSDTSSLQPQASLKQDVCQSYSEKMPIEIEQKPAQFATTVLPPIPANSFQLESDFRQLKSSPDMLYQYLKQIEPSLYPKLFQKNLDPDVFNQIVKILHDFYIEKEKPLLIFEILQRLSELKRFDMAVMFMSETEKKIARALFNHIDKSGLKDSSVEELKKRYGG

SEQ ID NO: 62459 - protein, 506 aa, Homo sapiens
MDADPYNPVLPTNRASAYFRLKKFAVAESDCNLAVALNRSYTKAYSRRGAARFALQKLEEAKKDYERVLELEPNNFEATNELRKISQALASKENSYPKEADIVIKSTEGERKQIEAQQNKQQAISEKDRGNGFFKEGKYERAIECYTRGIAADGANALLPANRAMAYLKIQKYEEAEKDCTQAILLDGSYSKAFARRGTARTFLGKLNEAKQDFETVLLLEPGNKQAVTELSKIKKELIEKGHWDDVFLDSTQRQNVVKPIDNPPHPGSTKPLKKVIIEETGNLIQTIDVPDSTTAAAPENNPINLANVIAATGTTSKKNSSQDDLFPTSDTPRAKVLKIEEVSDTSSLQPQASLKQDVCQSYSEKMPIEIEQKPAQFATTVLPPIPANSFQLESDFRQLKSSPDMLYQYLKQIEPSLYPKLFQKNLDPDVFNQIVKILHDFYIEKEKPLLIFEILQRLSELKRFDMAVMFMSETEKKIARALFNHIDKSGLKDSSVEELKKRYGG

SEQ ID NO: 62460 - protein, 1606 aa, Homo sapiens [sequence omitted]

SEQ ID NO: 62461 - protein, 1655 aa, Homo sapiens
MKWKHVPFLVMISLLSLSPNHLFLAQLIPDPEDVERGNDHGTPIPTSDNDDNSLGYTGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQGKVNEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEEPSS

SEQ ID NO: 62462 - protein, 1612 aa, Homo sapiens
MIAEPAHFYLFGLICLCSGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 62463 - protein, 1651 aa, Homo sapiens
MKWKHVPFLVMISLLSLSPNHLFLAQLIPDPEDVERGNDHGTPIPTSDNDDNSLGYTGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 62464 - protein, 1551 aa, Homo sapiens
MIAEPAHFYLFGLICLCSGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQVGSEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVTYQRGGEAVSSGGRPGLLNISEPAAQPWLADTWPNTGNNHNDCSISCCTAGNGNSDSNLTTYSRPGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 62465 - protein, 1606 aa, Homo sapiens
MIAEPAHFYLFGLICLCSGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQVGSEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 62466 - protein, 1070 aa, Homo sapiens
MARRHERVTRRMWTWAPGLLMMTVVFWGHQGNGQGQGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRGGVIAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGESGS

SEQ ID NO: 62467 - protein, 570 aa, Homo sapiens
MSTDEGTYMCIAENRVGKMEASATLTVRGGVIAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPNNTGYPICHDTDLAFQQHT

SEQ ID NO: 62468 - protein, 1394 aa, Homo sapiens
MARRHERVTRRMWTWAPGLLMMTVVFWGHQGNGQGQGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTWHIQSNNQPPQPPVPPLGYVSGALISDLETDVADDDADDEEEALEIPRPLRALDQTPGSSMDNLDSSVTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTGEL

SEQ ID NO: 62469 - protein, 1378 aa, Homo sapiens
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTWHIQSNNQPPQPPVPPLGYVSGALISDLETDVADDDADDEEEALEIPRPLRALDQTPGSSMDNLDSSVTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTGEL

SEQ ID NO: 62470 - protein, 1394 aa, Homo sapiens; identical to SEQ ID NO: 62468

SEQ ID NO: 62471 - protein, 1386 aa, Homo sapiens
MLRYLLKTLLQMNLFADSLAGDISNSSELLLGFNSSLAALNHTLLPPGDPSLNGSRVGPEDAMPRIVEQPPDLLVSRGEPATLPCRAEGRPRPNIEWYKNGARVATVREDPRAHRLLLPSGALFFPRIVHGRRARPDEGVYTCVARNYLGAAASRNASLEVAVLRDDFRQSPGNVVVAVGEPAVLECVPPRGHPEPSVSWRKDGARLKEEEGRITIRGGKLMMSHTLKSDAGMYVCVASNMAGERESAAAEVMVLERPSFLRRPVNQVVLADAPVTFLCEVKGDPPPRLRWRKEDGELPTGRYEIRSDHSLWIGHVSAEDEGTYTCVAENSVGRAEASGSLSVHVPPQLVTQPQDQMAAPGESVAFQCETKGNPPPAIFWQKEGSQVLLFPSQSLQPTGRFSVSPRGQLNITAVQRGDAGYYVCQAVSVAGSILAKALLEIKGASLDGLPPVILQGPANQTLVLGSSVWLPCRVTGNPQPSVRWKKDGQWLQGDDLQFKTMANGTLYIANVQEMDMGFYSCVAKSSTGEATWSGWLKMREDWGVSPDPPTEPSSPPGAPSQPVVTEITKNSITLTWKPNPQTGAAVTSYVIEAFSPAAGNTWRTVADGVQLETHTVSGLQPNTIYLFLVRAVGAWGLSEPSPVSEPVRTQDSSPSRPVEDPWRGQQGLAEVAVRLQEPIVLGPRTLQVSWTVDGPVQLVQGFRVSWRVAGPEGGSWTMLDLQSPSQQSTVLRGLPPGTQIQIKVQAQGQEGLGAESLSVTRSIPEEAPSGPPQGVAVALGGDGNSSITVSWEPPLPSQQNGVITEYQIWCLGNESRFHLNRSAAGWARSAMLRGLVPGLLYRTLVAAATSAGVGVPSAPVLVQLPSPPDLEPGLEVGAGLAVRLARVLREPAFLAGSGAACGALLLGLCAALYWRRKQRKELSHYTASFAYTPAVSFPHSEGLSGASSRPPMGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 62472 - protein, 1364 aa, Homo sapiens
MERPEDSLSLWSLNLSPQFPCLNALRHPLSPGSRVGPEDAMPRIVEQPPDLLVSRGEPATLPCRAEGRPRPNIEWYKNGARVATVREDPRAHRLLLPSGALFFPRIVHGRRARPDEGVYTCVARNYLGAAASRNASLEVAVLRDDFRQSPGNVVVAVGEPAVLECVPPRGHPEPSVSWRKDGARLKEEEGRITIRGGKLMMSHTLKSDAGMYVCVASNMAGERESAAAEVMVLERPSFLRRPVNQVVLADAPVTFLCEVKGDPPPRLRWRKEDGELPTGRYEIRSDHSLWIGHVSAEDEGTYTCVAENSVGRAEASGSLSVHVPPQLVTQPQDQMAAPGESVAFQCETKGNPPPAIFWQKEGSQVLLFPSQSLQPTGRFSVSPRGQLNITAVQRGDAGYYVCQAVSVAGSILAKALLEIKGASLDGLPPVILQGPANQTLVLGSSVWLPCRVTGNPQPSVRWKKDGQWLQGDDLQFKTMANGTLYIANVQEMDMGFYSCVAKSSTGEATWSGWLKMREDWGVSPDPPTEPSSPPGAPSQPVVTEITKNSITLTWKPNPQTGAAVTSYVIEAFSPAAGNTWRTVADGVQLETHTVSGLQPNTIYLFLVRAVGAWGLSEPSPVSEPVRTQDSSPSRPVEDPWRGQQGLAEVAVRLQEPIVLGPRTLQVSWTVDGPVQLVQGFRVSWRVAGPEGGSWTMLDLQSPSQQSTVLRGLPPGTQIQIKVQAQGQEGLGAESLSVTRSIPEEAPSGPPQGVAVALGGDGNSSITVSWEPPLPSQQNGVITEYQIWCLGNESRFHLNRSAAGWARSAMLRGLVPGLLYRTLVAAATSAGVGVPSAPVLVQLPSPPDLEPGLEVGAGLAVRLARVLREPAFLAGSGAACGALLLGLCAALYWRRKQRKELSHYTASFAYTPAVSFPHSEGLSGASSRPPMGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 62473 - protein, 149 aa, Homo sapiens
MTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 62474 - protein, 1007 aa, Homo sapiens
MGSGGDSLLGGRGSLPLLLLLIMGGMAQDSPPQILVHPQDQLFQGPGPARMSCQASGQPPPTIRWLLNGQPLSMVPPDPHHLLPDGTLLLLQPPARGHAHDGQALSTDLGVYTCEASNRLGTAVSRGARLSVAVLREDFQIQPRDMVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPQASSLSGPSPASSRLSSSSLSSLGEDQDSVLTPEEVALCLELSEGEETPRNSVSPMPRAPSPPTTYGYISVPTASEFTDMGRTGGGVGPKGGVLLCPPRPCLTPTPSEGSLANGWGSASEDNAASARASLVSSSDGSFLADAHFARALAVAVDSFGFGLEPREADCVFIDASSPPSPRDEIFLTPNLSLPLWEWRPDWLEDMEVSHTQRLGRGMPPWPPDSQISSQRSQLHCRMPKAGASPVDYS

SEQ ID NO: 62475 - protein, 701 aa, Homo sapiens
MGSGGDSLLGGRGSLPLLLLLIMVLREDFQIQPRDMVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPQASSLSGPSPASSRLSSSSLSSLGEDQDSVLTPEEVALCLELSEGEETP

SEQ ID NO: 62476 - protein, 862 aa, Homo sapiens
MVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPQASSLSGPSPASSRLSSSSLSSLGEDQDSVLTPEEVALCLELSEGEETPRNSVSPMPRAPSPPTTYGYISVPTASEFTDMGRTGGGVGPKGGVLLCPPRPCLTPTPSEGSLANGWGSASEDNAASARASLVSSSDGSFLADAHFARALAVAVDSFGFGLEPREADCVFIDASSPPSPRDEIFLTPNLSLPLWEWRPDWLEDMEVSHTQRLGRGMPPWPPDSQISSQRSQLHCRMPKAGASPVDYS

SEQ ID NO: 62477 - protein, 1235 aa, Homo sapiens
MSGPTDETAGDLPVKDTGLNLFGMGGLQETSTTRTMKSRQAVSRVSREELEDRFLRLHDENILLKQHARKQEDKIKRMATKLIRLVNDKKRYERVGGGPKRLGRDVEMEEMIEQLQEKVHELEKQNETLKNRLISAKQQLQTQGYRQTPYNNVQSRINTGRRKANENAGLQECPRKGIKFQDADVAETPHPMFTKYGNSLLEEARGEIRNLENVIQSQRGQIEELEHLAEILKTQLRRKENEIELSLLQLREQQATDQRSNIRDNVEMIKLHKQLVEKSNALSAMEGKFIQLQEKQRTLRISHDALMANGDELNMQLKEQRLKCCSLEKQLHSMKFSERRIEELQDRINDLEKERELLKENYDKLYDSAFSAAHEEQWKLKEQQLKVQIAQLETALKSDLTDKTEILDRLKTERDQNEKLVQENRELQLQYLEQKQQLDELKKRIKLYNQENDINADELSEALLLIKAQKEQKNGDLSFLVKVDSEINKDLERSMRELQATHAETVQELEKTRNMLIMQHKINKDYQMEVEAVTRKMENLQQDYELKVEQYVHLLDIRAARIHKLEAQLKDIAYGTKQYKFKPEIMPDDSVDEFDETIHLERGENLFEIHINKVTFSSEVLQASGDKEPVTFCTYAFYDFELQTTPVVRGLHPEYNFTSQYLVHVNDLFLQYIQKNTITLEVHQAYSTEYETIAACQLKFHEILEKSGRIFCTASLIGTKGDIPNFGTVEYWFRLRVPMDQAIRLYRERAKALGYITSNFKGPEHMQSLSQQAPKTAQLSSTDSTDGNLNELHITIRCCNHLQSRASHLQPHPYVVYKFFDFADHDTAIIPSSNDPQFDDHMYFPVPMNMDLDRYLKSESLSFYVFDDSDTQENIYIGKVNVPLISLAHDRCISGIFELTDHQKHPAGTIHVILKWKFAYLPPSGSITTEDLGNFIRSEEPEVVQRLPPASSVSTLVLAPRPKPRQRLTPVDKKVSFVDIMPHQSDVSQEGSVDEVKENTEKMQQGKDDVSLLSEGQLAEQSLASSEDETEITEDLEPEVEEDMSASDSDDCIIPGPISKNIKQPSEKIRIEIIALSLNDSQVTMDDTIQRLFVECRFYSLPAEETPVSLPKPKSGQWVYYNYSNVIYVDKENNKAKRDILKAILQKQEMPNRSLRFTVVSDPPEDEQDLECEDIGVAHVDLADMFQEGRDLIEQNIDVFDARADGEGIGKLRVTVEALHALQSVYKQYRDDLEA

SEQ ID NO: 62478 - protein, 1315 aa, Homo sapiens
MSGPTDETAGDLPVKDTGLNLFGMGGLQETSTTRTMKSRQAVSRVSREELEDRFLRLHDENILLKQHARKQEDKIKRMATKLIRLVNDKKRYERVGGGPKRLGRDVEMEEMIEQLQEKVHELEKQNETLKNRLISAKQQLQTQGYRQTPYNNVQSRINTGRRKANENAGLQECPRKGIKFQDADVAETPHPMFTKYGNSLLEEARGEIRNLENVIQSQRGQIEELEHLAEILKTQLRRKENEIELSLLQLREQQATDQRSNIRDNVEMIKLHKQLVEKSNALSAMEGKFIQLQEKQRTLRISHDALMANGDELNMQLKEQRLKCCSLEKQLHSMKFSERRIEELQDRINDLEKERELLKENYDKLYDSAFSAAHEEQWKLKEQQLKVQIAQLETALKSDLTDKTEILDRLKTERDQNEKLVQENRELQLQYLEQKQQLDELKKRIKLYNQENDINADELSEALLLIKAQKEQKNGDLSFLVKVDSEINKDLERSMRELQATHAETVQELEKTRNMLIMQHKINKDYQMEVEAVTRKMENLQQDYELKVEQYVHLLDIRAARIHKLEAQLKDIAYGTKQYKFKPEIMPDDSVDEFDETIHLERGENLFEIHINKVTFSSEVLQASGDKEPVTFCTYAFYDFELQTTPVVRGLHPEYNFTSQYLVHVNDLFLQYIQKNTITLEVHQAYSTEYETIAACQLKFHEILEKSGRIFCTASLIGTKGDIPNFGTVEYWFRLRVPMDQAIRLYRERAKALGYITSNFKGPEHMQSLSQQAPKTAQLSSTDSTDGNLNELHITIRCCNHLQSRASHLQPHPYVVYKFFDFADHDTAIIPSSNDPQFDDHMYFPVPMNMDLDRYLKSESLSFYVFDDSDTQENIYIGKVNVPLISLAHDRCISGIFELTDHQKHPAGTIHVILKWKFAYLPPSGSITTEDLGNFIRSEEPEVVQRLPPASSVSTLVLAPRPKPRQRLTPVDKKVSFVDIMPHQSDETSPPPEDRKEISPEVEHIPEIEINMLTVPHVPKVSQEGSVDEVKENTEKMQQGKDDVSLLSEGQLAEQSLASSEDETEITEDLEPEVEEDMSASDSDDCIIPGPISKNIKQSLALSPGLGCSSAISAHCNFRLPGSSDFPASASQVDGITGACHHTQPSEKIRIEIIALSLNDSQVTMDDTIQRLFVECRFYSLPAEETPVSLPKPKSGQWVYYNYSNVIYVDKENNKAKRDILKAILQKQEMPNRSLRFTVVSDPPEDEQDLECEDIGVAHVDLADMFQEGRDLIEQNIDVFDARADGEGIGKLRVTVEALHALQSVYKQYRDDLEA

SEQ ID NO: 62479 - protein, 651 aa, Homo sapiens
MAAPLLHTRLPGDAAASSSAVKKLGASRTGISNMRALENDFFNSPPRKTVRFGGTVTEVLLKYKKGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKDIVEDEDDDFLKGEVPQNDTVIGITPSSFDTHFRSPSSSVGSPPVLYMQPSPL

SEQ ID NO: 62480 - protein, 618 aa, Homo sapiens
MRALENDFFNSPPRKTVRFGGTVTEVLLKYKKGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKDIVEDEDDDFLKGEVPQNDTVIGITPSSFDTHFRSPSSSVGSPPVLYMQPSPL

SEQ ID NO: 62481 - protein, 621 aa, Homo sapiens
MAAPLLHTRLPGDAAASSSAVKKLGASRTGISNMRALENDFFNSPPRKTVRFGGTVTEVLLKYKKGETNDFELLKNQLLDPDIKRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKDIVEDEDDDFLKGEVPQNDTVIGITPSSFDTHFRSPSSSVGSPPVLYMQPSPL

SEQ ID NO: 62482 - protein, 469 aa, Homo sapiens
MIASHFVPPRVIIKEGDVDVSDSDDEDDNLPANFDTCHRALQIIARYVPSTPWFLMPILVEKFPFVRKSERTLVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKDIVEDEDDDFLKGEVPQNDTVIGITPSSFDTHFRSPSSSVGSPPVLYMQPSPL

SEQ ID NO: 62483 - protein, 263 aa, Homo sapiens
MRLGLCVVALVLSWTHLTISSRGIKGKRQRRISAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPAQCEMSEWSPWGPCSKKQQLCGFRRGSEERTRRVLHAPVGDHAACSDTKETRRCTVRRVPCPEGQKRRKGGQGRRENANRNLARKESKEAGAGSRRRKGQQQQQQQGTVGPLTSAGPA

SEQ ID NO: 62484 - protein, 263 aa, Homo sapiens; identical to SEQ ID NO: 62483

SEQ ID NO: 62485 - protein, 263 aa, Homo sapiens; identical to SEQ ID NO: 62483

SEQ ID NO: 62486 - protein, 200 aa, Homo sapiens
MRLGLCVVALVLSWTHLTISSRGIKGKRQRRISAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPGQKRRKGGQGRRENANRNLARKESKEAGAGSRRRKGQQQQQQQGTVGPLTSAGPA

SEQ ID NO: 62487 - protein, 236 aa, Homo sapiens
MIFRVSAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPAQCEMSEWSPWGPCSKKQQLCGFRRGSEERTRRVLHAPVGDHAACSDTKETRRCTVRRVPCPEGQKRRKGGQGRRENANRNLARKESKEAGAGSRRRKGQQQQQQQGTVGPLTSAGPA

SEQ ID NO: 62488 - protein, 243 aa, Homo sapiens
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 62489 - protein, 179 aa, Homo sapiens
MQFRLFSFALIILNCMDYSHCQGNRWRRSKRGCRIENCDSCFSKDFCTKCKVGFYLHRGRCFDECPDGFAPLEETMECVGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 62490 - protein, 179 aa, Homo sapiens; identical to SEQ ID NO: 62489

SEQ ID NO: 62491 - protein, 176 aa, Homo sapiens
MRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 62492 - protein, 168 aa, Homo sapiens
MRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVF

SEQ ID NO: 62493 - protein, 89 aa, Homo sapiens
MRQYGECLHSCPSGYYGHRAPDMNRCARCRIENCDSCFSKDFCTKCKVGFYLHRGRCFDECPDGFAPLEETMECVEGCEVGHWSEWGTC

SEQ ID NO: 62494 - protein, 121 aa, Homo sapiens
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHR

SEQ ID NO: 62495 - protein, 77 aa, Homo sapiens
MQFRLFSFALIILNCMDYSHCQGNRWRRSKRASYVSNPICKGCLSCSKDNGCSRCQQKLFFFLRREGMRQYGECLHS

SEQ ID NO: 62496 - protein, 234 aa, Homo sapiens
MRAPLCLLLLVAHAVDMLALNRRKKQVGTGLGGNCTGCIICSEENGCSTCQQRLFLFIRREGIRQYGKCLHDCPPGYFGIRGQEVNRCKKCGATCESCFSQDFCIRCKRQFYLYKGKCLPTCPPGTLAHQNTRECQGECELGPWGGWSPCTHNGKTCGSAWGLESRVREAGRAGHEEAATCQVLSESRKCPIQRPCPGERSPGQKKGRKDRRPRKDRKLDRRLDVRPRQPGLQP

SEQ ID NO: 62497 - protein, 172 aa, Homo sapiens
MRAPLCLLLLVAHAVDMLALNRRKKQVGTGLGGNCTGCIICSEENGCSTCQQRLFLFIRREGIRQYGKCLHDCPPGYFGIRGQEVNRCKKCGATCESCFSQDFCIRCKRQFYLYKGKCLPTCPPGTLAHQNTRECQERSPGQKKGRKDRRPRKDRKLDRRLDVRPRQPGLQP

SEQ ID NO: 62498 - protein, 710 aa, Homo sapiens
MRGRLCVGRAAAAAAAVAVPLAGGQEGSPGGGRRGSRGTTMVKKRKGRVVIDSDTEDSGSDENLDQELLSLAKRKRSDSEEKEPPVSQPAASSDSETSDSDDEWTFGSNKNKKKGKARKIEKKGTMKKQANKTASSGSSDKDSSAESSAPEEGEVSDSDSNSSSSSSDSDSSSEDEEFHDGYGEDLMGDEEDRARLEQMTEKEREQELFNRIEKREVLKRRFEIKKKLKTAKKKEKKEKKKKQEEEQEKKKLTQIQESQVTSHNKERRSKRDEKLDKKSQAMEELKAEREKRKNRTAELLAKKQPLKTSEVYSDDEEEEEDDKSSEKSDRSSRTSSSDEEEEKEEIPPKSQPVSLPEELNRVRLSRHKLERWCHMPFFAKTVTGCFVRIGIGNHNSKPVYRVAEITGVVETAKVYQLGGTRTNKGLQLRHGNDQRVFRLEFVSNQEFTESEFMKWKEAMFSAGMQLPTLDEINKKELSIKEALNYKFNDQDIEEIVKEKERFRKAPPNYAMKKTQLLKEKAMAEDLGDQDKAKQIQDQLNELEERAEALDRQRTKNISAISYINQRNREWNIVESEKALVAESHNMKNQQMDPFTRRQCKPTIVSNSRDPAVQAAILAQLNAKYGSGVLPDAPKEMSKGQGKDKDLNSKSASDLSEDLFKVHDFDVKIDLQVPSSESKALAITSKAPPAKDGAPRRSLNLEDYKKRRGLI

SEQ ID NO: 62499 - protein, 1516 aa, Homo sapiens
MDSPPKLTGETLIVHHIPLVHCQVPDRQCCGGAGGGGGSTRPNPFCPPELGITQPDQDLGQADSLLFSSLHSTPGGTARSIDSTKSRSRDGRGPGAPKRHNPFLLQEGVGEPGLGDLYDDSIGDSATQQSFHLHGTGQPNFHLSSFQLPPSGPRVGRPWGTTRSRAGVVEGQEQEPVMTLDTQQCGTSHCCRPELEAETMELDECGGPGGSGSGGGASDTSGFSFDQEWKLSSDESPRNPGCSGSGDQHCRCSSTSSQSEAADQSMGYVSDSSCNSSDGVLVTFSTLYNKMHGTPRANLNSAPQSCSDSSFCSHSDPGAFYLDLQPSPFESKMSYESHHPESGGREGGYGCPHASSPELDANCNSYRPHCEPCPAVADLTACFQSQARLVVATQNYYKLVTCDLSSQSSPSPAGSSITSCSEEHTKISPPPGPGPDPGPSQPSEYYLFQKPEVQPEEQEAVSSSTQAAAAVGPTVLEGQVYTNTSPPNLSTGRQRSRSYDRSLQRSPPVRLGSLERMLSCPVRLSEGPAAMAGPGSPPRRVTSFAELAKGRKKTGGSGSPPLRVSVGDSSQEFSPIQEAQQDRGAPLDEGTCCSHSLPPMPLGPGMDLLGPDPSPPWSTQVCQGPHSSEMPPAGLRATGQGPLAQLMDPGPALPGSPANSHTQRDARARADGGGTESRPVLRYSKEQRPTTLPIQPFVFQHHFPKQLAKARALHSLSQLYSLSGCSRTQQPAPLAAPAAQVSVPAPSGEPQASTPRATGRGARKAGSEPETSRPSPLGSYSPIRSVGPFGPSTDSSASTSCSPPPEQPTATESLPPWSHSCPSAVRPATSQQPQKEDQKILTLTEYRLHGTGSLPPLGSWRSGLSRAESLARGGGEGSMATRPSNANHLSPQALKWREYRRKNPLGPPGLSGSLDRRSQEARLARRNPIFEFPGSLSAASHLNCRLNGQAVKPLPLTCPDFQDPFSLTEKPPAEFCLSPDGSSEAISIDLLQKKGLVKAVNIAVDLIVAHFGTSRDPGVKAKLGNSSVSPNVGHLVLKYLCPAVRAVLEDGLKAFVLDVIIGQRKNMPWSVVEASTQLGPSTKVLHGLYNKVSQFPELTSHTMRFNAFILGLLNIRSLEFWFNHLYNHEDIIQTHYQPWGFLSAAHTVCPGLFEELLLLLQPLALLPFSLDLLFQHRLLQSGQQQRQHKELLRVSQDLLLSAHSTLQLARARGQEGPGDVDRAAQGERVKGVGASEGGEEEEEEEETEEVAEAAGGSGRARWARGGQAGWWYQLMQSSQVYIDGSIEGSRFPRGSSNSSSEKKKGAGGGGPPQAPPPREGVVEGAEACPASEEALGRERGWPFWMGSPPDSVLAELRRSREREGPAASPAENEEGASEPSPGGIKWGHLFGSRKAQREARPTNRLPSDWLSLDKSMFQLVAQTVGSRREPEPKESLQEPHSPALPSSPPCEVQALCHHLATGPGQLSFHKGDILRVLGRAGGDWLRCSRGPDSGLVPLAYVTLTPTPSPTPGSSQN

SEQ ID NO: 62500 - protein, 1516 aa, Homo sapiens; identical to SEQ ID NO: 62499

SEQ ID NO: 62501 - protein, 924 aa, Homo sapiens
MDSPPKLTGETLIVHHIPLVHCQVPDRQCCGGAGGGGGSTRPNPFCPPELGITQPDQDLGQADSLLFSSLHSTPGGTARSIDSTKSRSRDGRGPGAPKRHNPFLLQEGVGEPGLGDLYDDSIGDSATQQSFHLHGTGQPNFHLSSFQLPPSGPRVGRPWGTTRSRAGVVEGQEQEPVMTLDTQQCGTSHCCRPELEAETMELDECGGPGGSGSGGGASDTSGFSFDQEWKLSSDESPRNPGCSGSGDQHCRCSSTSSQSEAADQSMGYVSDSSCNSSDGVLVTFSTLYNKMHGTPRANLNSAPQSCSDSSFCSHSDPGAFYLDLQPSPFESKMSYESHHPESGGREGGYGCPHASSPELDANCNSYRPHCEPCPAVADLTACFQSQARLVVATQNYYKLVTCDLSSQSSPSPAGSSITSCSEEHTKISPPPGPGPDPGPSQPSEYYLFQKPEVQPEEQEAVSSSTQAAAAVGPTVLEGQVYTNTSPPNLSTGRQRSRSYDRSLQRSPPVRLGSLERMLSCPVRLSEGPAAMAGPGSPPRRVTSFAELAKGRKKTGGSGSPPLRVSVGDSSQEFSPIQEAQQDRGAPLDEGTCCSHSLPPMPLGPGMDLLGPDPSPPWSTQVCQGPHSSEMPPAGLRATGQGPLAQLMDPGPALPGSPANSHTQRDARARADGGGTESRPVLRYSKEQRPTTLPIQPFVFQHHFPKQLAKARALHSLSQLYSLSGCSRTQQPAPLAAPAAQVSVPAPSGEPQASTPRATGRGARKAGSEPETSRPSPLGSYSPIRSVGPFGPSTDSSASTSCSPPPEQPTATESLPPWSHSCPSAVRPATSQQPQKEDQKILTLTEYRLHGTGSLPPLGSWRSGLSRAESLARGGGEGSMATRPSNANHLSPQALKWREYRRKNPLGPPGLSGSLDRRSQEARTG

SEQ ID NO: 62502 - protein, 405 aa, Homo sapiens
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIGSSEPN

SEQ ID NO: 62503 - protein, 446 aa, Homo sapiens
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIGKDPTPSMLGLCGSLASIPSCKSLASFKSNECLVSDSPEGSPALSPS

SEQ ID NO: 62504 - protein, 456 aa, Homo sapiens
MKIEEVKSTTKTQRIASHSHVKGLGLDESGLAKQAASGLVGQENAREACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQIIKIRAQTEGINISEEALNHLGEIGTKTTLRYSVQLLTPANLLAKINGKDSIEKEHVEEISELFYDAKSSAKILADQQDKYMK

SEQ ID NO: 62505 - protein, 386 aa, Homo sapiens
MKIEEVKSTTKTQRIASHSHVKGLGLDESGLAKQAASGLVGQENAREACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQVLSAAADPGQLAC

SEQ ID NO: 62506 - protein, 463 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGELQKRKEVVHTVSLHEIDVINSRTQGFLALFSGDTGEIKSEVREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRCEEEDVEMSEDAYTVLTRIGLETSLRYAIQLITAASLVCRKRKGTEVQVDDIKRVYSLFLDESRSTQYMKEYQDAFLFNELKGETMDTS

SEQ ID NO: 62507 - protein, 418 aa, Homo sapiens
MVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGELQKRKEVVHTVSLHEIDVINSRTQGFLALFSGDTGEIKSEVREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRCEEEDVEMSEDAYTVLTRIGLETSLRYAIQLITAASLVCRKRKGTEVQVDDIKRVYSLFLDESRSTQYMKEYQDAFLFNELKGETMDTS

SEQ ID NO: 62508 - protein, 463 aa, Homo sapiens; identical to SEQ ID NO: 62506

SEQ ID NO: 62509 - protein, 5033 aa, Homo sapiens
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 62510 - protein, 5038 aa, Homo sapiens
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKAGDIQSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 62511 - protein, 5033 aa, Homo sapiens
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKAGDIQSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 62512 - protein, 676 aa, Homo sapiens
MKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKAGDIQSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQ

SEQ ID NO: 62513 - protein, 4973 aa, Homo sapiens
LGPRSSSNKLSNKKMMKWFCSAPQPSTKNNRSYAWQQKDLATDFVSWSPLPIPRMCPQTSPSAPLCWSSPSLSGRCRRCWLTPWRNQKGQLDIIKWSFGLKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTLLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKVQPLMKPYKLLSEKEKEIYRWPIKESLKTMLAWGWRIERTREGDSMALYNRTRRISQTSQVSVDAAHGYSPRAIDMSNVTLSRDLHAMAEMMAENYHNIWAKKKKMELESKGGGNHPLLVPYDTLTAKEKAKDREKAQDILKFLQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEVTGSQRSKEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQEQKAKEEEKEEKEETKSEPEKAEGEDGEKEEKAKEDKGKQKLRQLHTHRYGEPEVPESAFWKKIIAYQQKLLNYFARNFYNMRMLALFVAFAINFILLFYKVSTSSVVEGKELPTRSSSENAKVTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 62514 - protein, 4967 aa, Homo sapiens
MADGGEGEDEIQFLRTDDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTLLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKVQPLMKPYKLLSEKEKEIYRWPIKESLKTMLAWGWRIERTREGDSMALYNRTRRISQTSQVSVDAAHGYSPRAIDMSNVTLSRDLHAMAEMMAENYHNIWAKKKKMELESKGGGNHPLLVPYDTLTAKEKAKDREKAQDILKFLQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQEQKAKEEEKEEKEETKSEPEKAEGEDGEKEEKAKEDKGKQKLRQLHTHRYGEPEVPESAFWKKIIAYQQKLLNYFARNFYNMRMLALFVAFAINFILLFYKVSTSSVVEGKELPTRSSSENAKVTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 62515 - protein, 328 aa, Homo sapiens
MEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMEVFSDVSYKQR

SEQ ID NO: 62516 - protein, 214 aa, Homo sapiens
SLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIV

SEQ ID NO: 62517 - protein, 1421 aa, Homo sapiens
MKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEHDIIKDLRNKFASLGENSLEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQEQKAKEEEKEEKEETKSEPEKAEGEDG

SEQ ID NO: 62518 - protein, 4951 aa, Homo sapiens
DDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTLLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKVQPLMKPYKLLSEKEKEIYRWPIKESLKTMLAWGWRIERTREGDSMALYNRTRRISQTSQVSVDAAHGYSPRAIDMSNVTLSRDLHAMAEMMAENYHNIWAKKKKMELESKGGGNHPLLVPYDTLTAKEKAKDREKAQDILKFLQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQEQKAKEEEKEEKEETKSEPEKAEGEDGEKEEKAKEDKGKQKLRQLHTHRYGEPEVPESAFWKKIIAYQQKLLNYFARNFYNMRMLALFVAFAINFILLFYKVSTSSVVEGKELPTRSSSENAKVTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 62519 - protein, 4866 aa, Homo sapiens
MAELGGGGEEDARWYRKEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVSTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCRSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 62520 - protein, 4870 aa, Homo sapiens
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVSTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKAMQVKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 62521 - protein, 4865 aa, Homo sapiens
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVSTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 62522 - protein, 94 aa, Homo sapiens
MGSELETAMETLINVFHAHSGKEGDKYKLSKKELKELLQTELSGFLDAQKDVDAVDKVMKELDENGDGEVDFQEYVVLVAALTVACNNFFWENS

SEQ ID NO: 62523 - protein, 53 aa, Homo sapiens
MGSELETAMETLINVFHAHSGKEGDKYKLSKKELKELLQTELSGFLDVKELML

SEQ ID NO: 62524 - protein, 147 aa, Homo sapiens
MEEPQTKTPSAEFPPYRAQPAQPATAPAATFATLAICPEPAPTSGPGQPCTAAMGSELETAMETLINVFHAHSGKEGDKYKLSKKELKELLQTELSGFLDAQKDVDAVDKVMKELDENGDGEVDFQEYVVLVAALTVACNNFFWENS

SEQ ID NO: 62525 - protein, 34 aa, Homo sapiens
MGSELETAMETLINVFHAHSGKEGDKYKLSKKEL

SEQ ID NO: 62526 - protein, 97 aa, Homo sapiens
MPSQMEHAMETMMFTFHKFAGDKGYLTKEDLRVLMEKEFPGFLENQKDPLAVDKIMKDLDQCRDGKVGFQSFFSLIAGLTIACNDYFVVHMKQKGKK

SEQ ID NO: 62527 - protein, 97 aa, Homo sapiens; identical to SEQ ID NO: 62526

SEQ ID NO: 62528 - protein, 105 aa, Homo sapiens
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 62529 - protein, 83 aa, Homo sapiens
AGKMTKLEEHLEGIVNIFHQYSVRKGHFDTLSKGELKQLLTKELANTIKRPKKGSSVIDEIFQGLDANQDEQVDFQEFISLVA

SEQ ID NO: 62530 - protein, 92 aa, Homo sapiens
MTKLEEHLEGIVNIFHQYSVRKGHFDTLSKGELKQLLTKELANTIKNIKDKAVIDEIFQGLDANQDEQVDFQEFISLVAIALKAAHYHTHKE

SEQ ID NO: 62531 - protein, 98 aa, Homo sapiens
MAAEPLTELEESIETVVTTFFTFARQEGRKDSLSVNEFKELVTQQLPHLLKDVGSLDEKMKSLDVNQDSELKFNEYWRLIGELAKEIRKKKDLKIRKK

SEQ ID NO: 62532 - protein, 98 aa, Homo sapiens; identical to SEQ ID NO: 62531

SEQ ID NO: 62533 - protein, 98 aa, Homo sapiens; identical to SEQ ID NO: 62531

SEQ ID NO: 62534 - protein, 98 aa, Homo sapiens; identical to SEQ ID NO: 62531

SEQ ID NO: 62535 - protein, 98 aa, Homo sapiens; identical to SEQ ID NO: 62531

SEQ ID NO: 62536 - protein, 104 aa, Homo sapiens
MGQCRSANAEDAQEFSDVERAIETLIKNFHQYSVEGGKETLTPSELRDLVTQQLPHLMPSNCGLEEKIANLGSCNDSKLEFRSFWELIGEAAKSVKLERPVRGH

SEQ ID NO: 62537 - protein, 104 aa, Homo sapiens; identical to SEQ ID NO: 62536

SEQ ID NO: 62538 - protein, 104 aa, Homo sapiens; identical to SEQ ID NO: 62536

SEQ ID NO: 62539 - protein, 104 aa, Homo sapiens; identical to SEQ ID NO: 62536

SEQ ID NO: 62540 - protein, 138 aa, Homo sapiens
MCSSLEQALAVLVTTFHKYSCQEGDKFKLSKGEMKELLHKELPSFVGHSREPCAVRAFRVHLFNPVIGDLRNQSPEGKSDCPKITQHWEKVDEEGLKKLMGSLDENSDQQVDFQEYAVFLALITVMCNDFFQGCPDRP

SEQ ID NO: 62541 - protein, 97 aa, Homo sapiens
MCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 62542 - protein, 97 aa, Homo sapiens; identical to SEQ ID NO: 62541

SEQ ID NO: 62543 - protein, 97 aa, Homo sapiens; identical to SEQ ID NO: 62541

SEQ ID NO: 62544 - protein, 101 aa, Homo sapiens
MARPLEQAVAAIVCTFQEYAGRCGDKYKLCQAELKELLQKELATWTPTEFRECDYNKFMSVLDTNKDCEVDFVEYVRSLACLCLYCHEYFKDCPSEPPCSQ

SEQ ID NO: 62545 - protein, 101 aa, Homo sapiens; identical to SEQ ID NO: 62544

SEQ ID NO: 62546 - protein, 101 aa, Homo sapiens
MACPLEKALDVMVSTFHKYSGKEGDKFKLNKSELKELLTRELPSFLGKRTDEAAFQKLMSNLDSNRDNEVDFQEYCVFLSCIAMMCNEFFEGFPDKQPRKK

SEQ ID NO: 62547 - protein, 101 aa, Homo sapiens; identical to SEQ ID NO: 62546

SEQ ID NO: 62548 - protein, 101 aa, Homo sapiens; identical to SEQ ID NO: 62546

SEQ ID NO: 62549 - protein, 101 aa, Homo sapiens; identical to SEQ ID NO: 62546

SEQ ID NO: 62550 - protein, 90 aa, Homo sapiens [sequence omitted]

SEQ ID NO: 62551 - protein, 110 aa, Homo sapiens
MPAAWILWAHSHSELHTVMETPLEKALTTMVTTFHKYSGREGSKLTLSRKELKELIKKELCLGEMKESSIDDLMKSLDKNSDQEIDFKEYSVFLTMLCMAYNDFFLEDNK

SEQ ID NO: 62552 - protein, 92 aa, Homo sapiens
METPLEKALTTMVTTFHKYSGREGSKLTLSRKELKELIKKELCLGEMKESSIDDLMKSLDKNSDQEIDFKEYSVFLTMLCMAYNDFFLEDNK

SEQ ID NO: 62553 - protein, 92 aa, Homo sapiens; identical to SEQ ID NO: 62552

SEQ ID NO: 62554 - protein, 90 aa, Homo sapiens
MACPLDQAIGLLVAIFHKYSGREGDKHTLSKKELKELIQKELTIGSKLQDAEIARLMEDLDRNKDQEVNFQEYVTFLGALALIYNEALKG

SEQ ID NO: 62555 - protein, 90 aa, Homo sapiens; identical to SEQ ID NO: 62554

SEQ ID NO: 62556 - protein, 101 aa, Homo sapiens
MSNTQAERSIIGMIDMFHKYTRRDDKIEKPSLLTMMKENFPNFLSACDKKGTNYLADVFEKKDKNEDKKIDFSEFLSLLGDIATDYHKQSHGAAPCSGGSQ

SEQ ID NO: 62557 - protein, 101 aa, Homo sapiens; identical to SEQ ID NO: 62556

SEQ ID NO: 62558 - protein, 93 aa, Homo sapiens
MLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 62559 - protein, 93 aa, Homo sapiens; identical to SEQ ID NO: 62558

SEQ ID NO: 62560 - protein, 114 aa, Homo sapiens
MTCKMSQLERNIETIINTFHQYSVKLGHPDTLNQGEFKELVRKDLQNFLKKENKNEKVIEHIMEDLDTNADKQLSFEEFIMLMARLTWASHEKMHEGDEGPGHHHKPGLGEGTP

SEQ ID NO: 62561 - protein, 92 aa, Homo sapiens
MSELEKAMVALIDVFHQYSGREGDKHKLKKSELKELINNELSHFLEEIKEQEVVDKVMETLDNDGDGECDFQEFMAFVAMVTTACHEFFEHE

SEQ ID NO: 62562 - protein, 92 aa, Homo sapiens; identical to SEQ ID NO: 62561

SEQ ID NO: 62563 - protein, 95 aa, Homo sapiens
MTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 62564 - protein, 99 aa, Homo sapiens
MPTQLEMAMDTMIRIFHRYSGKERKRFKLSKGELKLLLQRELTEFLSCQKETQLVDKIVQDLDANKDNEVDFNEFVVMVAALTVACNDYFVEQLKKKGK

SEQ ID NO: 62565 - protein, 99 aa, Homo sapiens; identical to SEQ ID NO: 62564

SEQ ID NO: 62566 - protein, 342 aa, Homo sapiens
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLSTSSGHGPAHTKPLNRRSVLEKNLIKVTVAPFNPTVCDALLDKDETDSSKDTEKLSSLGEEMREDGLSPNESKLCTESEGISPNNSAWNGPQLSSSNNNFQQTVSDKNMPDSENPTSVFSRISDHSETPNMELSCRNGGSHKSSCEMRSLVVSTSSNKQDVLNKDSGKMKGHERRLGKVIPVLQTKTRTNVPTFSQSNLEQQKQLYLRSVIAHIEDPEDTNQG

SEQ ID NO: 62567 - protein, 408 aa, Homo sapiens
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLSTSSGHGPAHTKPLNRRSVLEKNLIKVTVAPFNPTVCDALLDKDETDSSKDTEKLSSLGEEMREDGLSPNESKLCTESEGISPNNSAWNGPQLSSSNNNFQQTVSDKNMPDSENPTSVFSRISDHSETPNMELSCRNGGSHKSSCEMRSLVVSTSSNKQDVLNKDSGKMKGHERRLGKVIPVLQTKTRTNVPTFSQSNLEQQKQLYLRSVIAHIEDPEDTNQGISGELCALMDQVHHMQHSKWQHPSDLTTRNYARRQKHLQRYSLTQWVDRNMRSHHRFQRLPDFSYS

SEQ ID NO: 62568 - protein, 408 aa, Homo sapiens; identical to SEQ ID NO: 62567

SEQ ID NO: 62569 - protein, 341 aa, Homo sapiens
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLSTSSGHGPAHTKPLNRRSVLEKNLIKVTVAPFNPTVCDALLDKDETDSSKDTEKLSSLGEEMREDGLSPNESKLCTESEGISPNNSAWNGPQLSSSNNNFQQTVSDKNMPDSENPTSVFSRISDHSETPNMELSCRNGGSHKSSCEMRSLVVSTSSNKDVLNKDSGKMKGHERRLGKVIPVLQTKTRTNVPTFSQSNLEQQKQLYLRSVIAHIEDPEDTNQG

SEQ ID NO: 62570 - protein, 146 aa, Homo sapiens
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLSTSSGHGPAHTKPLNRRSVLEKNLIKV

SEQ ID NO: 62571 - protein, 120 aa, Homo sapiens
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLS

SEQ ID NO: 62572 - protein, 41 aa, Homo sapiens
MMCSRVPSEQSSGTSLLPKDGAPFSWDSLDEDGLDDSLLEL

SEQ ID NO: 62573 - protein, 5 aa, Homo sapiens
MMCSR

SEQ ID NO: 62574 - protein, 130 aa, Homo sapiens
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLSTSSGHGPAHT

SEQ ID NO: 62575 - protein, 341 aa, Homo sapiens; identical to SEQ ID NO: 62569

SEQ ID NO: 62576 - protein, 171 aa, Homo sapiens
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLSTSSGHGPAHTKPLNRRSVLEKNLIKVTVAPFNPTVCDALLDKDETDSSKDT

SEQ ID NO: 62577 - protein, 587 aa, Homo sapiens
MATAAYEQLKLHITPEKFYVEACDDGADDVLTIDRVSTEVTLAVKKDVPPSAVTRPIFGILGTIHLVAGNYLIVITKKIKVGEFFSHVVWKATDFDVLSYKKTMLHLTDIQLQDNKTFLAMLNHVLNVDGFYFSTTYDLTHTLQRLSNTSPEFQEMSLLERADQRFVWNGHLLRELSAQPEVHRFALPVLHGFITMHSCSINGKYFDWILISRRSCFRAGVRYYVRGIDSEGHAANFVETEQIVHYNGSKASFVQTRGSIPVFWSQRPNLKYKPLPQISKVANHMDGFQRHFDSQVIIYGKQVIINLINQKGSEKPLEQTFATMVSSLGSGMMRYIAFDFHKECKNMRWDRLSILLDQVAEMQDELSYFLVDSAGQVVANQEGVFRSNCMDCLDRTNVIQSLLARRSLQAQLQRLGVLHVGQKLEEQDEFEKIYKNAWADNANACAKQYAGTGALKTDFTRTGKRTHLGLIMDGWNSMIRYYKNNFSDGFRQDSIDLFLGNYSVDELESHSPLSVPRDWKFLALPIIMVVAFSMCIICLLMAGDTWTETLAYVLFWGVASIGTFFIILYNGKDFVDAPRLVQKEKID

SEQ ID NO: 62578 - protein, 526 aa, Homo sapiens
MWKLVMMEQMTYLPLTVCPQRLPLQSRKMFLLQLSQDQYLVYWAQSIWWQLQDNKTFLAMLNHVLNVDGFYFSTTYDLTHTLQRLSNTSPEFQEMSLLERADQRFVWNGHLLRELSAQPEVHRFALPVLHGFITMHSCSINGKYFDWILISRRSCFRAGVRYYVRGIDSEGHAANFVETEQIVHYNGSKASFVQTRGSIPVFWSQRPNLKYKPLPQISKVANHMDGFQRHFDSQVIIYGKQVIINLINQKGSEKPLEQTFATMVSSLGSGMMRYIAFDFHKECKNMRWDRLSILLDQVAEMQDELSYFLVDSAGQVVANQEGVFRSNCMDCLDRTNVIQSLLARRSLQAQLQRLGVLHVGQKLEEQDEFEKIYKNAWADNANACAKQYAGTGALKTDFTRTGKRTHLGLIMDGWNSMIRYYKNNFSDGFRQDSIDLFLGNYSVDELESHSPLSVPRDWKFLALPIIMVVAFSMCIICLLMAGDTWTETLAYVLFWGVASIGTFFIILYNGKDFVDAPRLVQKEKID

SEQ ID NO: 62579 - protein, 717 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 62580 - protein, 738 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVEDSEGRGSKVTETEPVSSFPAGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 62581 - protein, 717 aa, Homo sapiens; identical to SEQ ID NO: 62579

SEQ ID NO: 62582 - protein, 717 aa, Homo sapiens; identical to SEQ ID NO: 62579

SEQ ID NO: 62583 - protein, 706 aa, Homo sapiens
MVSPPSAGQRLRGVPVWAAGAFRFSSGEESTSHLIMSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 62584 - protein, 124 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWDPTFQKLLEAQKSPWFFPAQVRTCGCGGG

SEQ ID NO: 62585 - protein, 127 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGYSDVDQQSSSSRLRSAVSRAGSLLWMVATSP

SEQ ID NO: 62586 - protein, 110 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGS

SEQ ID NO: 62587 - protein, 224 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHF

SEQ ID NO: 62588 - protein, 101 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRV

SEQ ID NO: 62589 - protein, 144 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVGRR

SEQ ID NO: 62590 - protein, 205 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVGYSDVDQQSSSSRLRSAVSRAGSLLWMVATSPGRLFRLLYWWAGTTWYRLTTAASLLDVFVLTR

SEQ ID NO: 62591 - protein, 379 aa, Homo sapiens
MPRSSRSPGDPGALLEDVAHNPRPRRIAQRGRNTSRMAEDTSPNMNDNILLPVRNNDQALGLTQCMLGCVSWFTCFACSLRTQAQQVLFNTCRCKLLCQKLMEKTGILLLCAFGFWMFSIHLPSKMKVWQDDSINGPLQSLRLYQEKVRHHSGEIQDLRGSMNQLIAKLQEMEAMSDEQKMAQKIMKMIHGDYIEKPDFALKSIGASIDFEHTSVTYNHEKAHSYWNWIQLWNYAQPPDVILEPNVTPGNCWAFEGDRGQVTIQLAQKVYLSNLTLQHIPKTISLSGSLDTAPKDFVIYGMEGSPKEEVFLGAFQFQPENIIQMFPLQNQPARAFSAVKVKISSNWGNPGFTCLYRVRVHGSVAPPREQPHQNPYPKRD

SEQ ID NO: 62592 - protein, 122 aa, Homo sapiens
MPRSSRSPGDPGALLEDVAHNPRPRRIAQRGRNTSRMAEDTSPNMNDNILLPVRNNDQALGLTQCMLGCVYASCCARSSWRRQAFCSSVLSVCPRALPSPRWRYPWALALIIGHWARHCTAT

SEQ ID NO: 62593 - protein, 354 aa, Homo sapiens
MPRSSRSPGDPGALLEDVAHNPRPRRIAQRGRNTSRMAEDTSPNMTWFTCFACSLRTQAQQVLFNTCRCKLLCQKLMEKTGILLLCAFGFWMFSIHLPSKMKVWQDDSINGPLQSLRLYQEKVRHHSGEIQDLRGSMNQLIAKLQEMEAMSDEQKMAQKIMKMIHGDYIEKPDFALKSIGASIDFEHTSVTYNHEKAHSYWNWIQLWNYAQPPDVILEPNVTPGNCWAFEGDRGQVTIQLAQKVYLSNLTLQHIPKTISLSGSLDTAPKDFVIYGMEGSPKEEVFLGAFQFQPENIIQMFPLQNQPARAFSAVKVKISSNWGNPGFTCLYRVRVHGSVAPPREQPHQNPYPKRD

SEQ ID NO: 62594 - protein, 152 aa, Homo sapiens
GALLEDVAHNPRPRRIAQRGRNTSRMAEDTSPNMNDNILLPVRNNDQALGLTQCMLGCVSWFTCFACSLRTQAQQVLFNTCRCKLLCQKLMEKTGILLLCAFGVSQGPAQSQVEVSLGPGTDYRTLGKTLHCHVTQFPHLPDGCCCENYEMK

SEQ ID NO: 62595 - protein, 128 aa, Homo sapiens
MSEGGGQVSCIFAAPTRLCRWPALIECGVNLTQPLCEWMIQVARDRTLSLAWEVASLLTLSSSEVGLEGVGTIWPSSYSSEESSRNGAEQGRQLSIEGPFQGQNCPSHPAAALPLPMRGESQATSCQV

SEQ ID NO: 62596 - protein, 1324 aa, Homo sapiens
MSRRKQAKPQHFQSDPEVASLPRRDGDTEKGQPSRPTKSKDAHVCGRCCAEFFELSDLLLHKKNCTKNQLVLIVNENPASPPETFSPSPPPDNPDEQMNDTVNKTDQVDCSDLSEHNGLDREESMEVEAPVANKSGSGTSSGSHSSTAPSSSSSSSSSSGGGGSSSTGTSAITTSLPQLGDLTTLGNFSVINSNVIIENLQSTKVAVAQFSQEARCGGASGGKLAVPALMEQLLALQQQQIHQLQLIEQIRHQILLLASQNADLPTSSSPSQGTLRTSANPLSTLSSHLSQQLAAAAGLAQSLASQSASISGVKQLPPIQLPQSSSGNTIIPSNSGSSPNMNILAAAVTTPSSEKVASSAGASHVSNPAVSSSSSPAFAISSLLSPASNPLLPQQASANSVFPSPLPNIGTTAEDLNSLSALAQQRKSKPPNVTAFEAKSTSDEAFFKHKCRFCAKVFGSDSALQIHLRSHTGERPFKCNICGNRFSTKGNLKVHFQRHKEKYPHIQMNPYPVPEHLDNIPTSTGIPYGMSIPPEKPVTSWLDTKPVLPTLTTSVGLPLPPTLPSLIPFIKTEEPAPIPISHSATSPPGSVKSDSGGPESATRNLGGLPEEAEGSTLPPSGGKSEESGMVTNSVPTASSSVLSSPAADCGPAGSATTFTNPLLPLMSEQFKAKFPFGGLLDSAQASETSKLQQLVENIDKKATDPNECIICHRVLSCQSALKMHYRTHTGERPFKCKICGRAFTTKGNLKTHYSVHRAMPPLRVQHSCPICQKKFTNAVVLQQHIRMHMGGQIPNTPVPDSYSESMESDTGSFDEKNFDDLDNFSDENMEDCPEGSIPDTPKSADASQDSLSSSPLPLEMSSIAALENQMKMINAGLAEQLQASLKSVENGSIEGDVLTNDSSSVGGDMESQSAGSPAISESTSSMQALSPSNSTQEFHKSPSIEEKPQRAVPSEFANGLSPTPVNGGALDLTSSHAEKIIKEDSLGILFPFRDRGKFKNTACDICGKTFACQSALDIHYRSHTKERPFICTVCNRGFSTKGNLKQHMLTHQMRDLPSQLFEPSSNLGPNQNSAVIPANSLSSLIKTEVNGFVHVSPQDSKDTPTSHVPSGPLSSSATSPVLLPALPRRTPKQHYCNTCGKTFSSSSALQIHERTHTGEKPFACTICGRAFTTKGNLKVHMGTHMWNSTPARRGRRLSVDGPMTFLGGNPVKFPEMFQKDLAARSGSGDPSSFWNQYAAALSNGLAMKANEISVIQNGGIPPIPGSLGSGNSSPVSGLTGNLERLQNSEPNAPLAGLEKMASSENGTNFRFTRFVEDSKEIVTS

SEQ ID NO: 62597 - protein, 1227 aa, Homo sapiens
MNDTVNKTDQVDCSDLSEHNGLDREESMEVEAPVANKSGSGTSSGSHSSTAPSSSSSSSSSSGGGGSSSTGTSAITTSLPQLGDLTTLGNFSVINSNVIIENLQSTKVAVAQFSQEARCGGASGGKLAVPALMEQLLALQQQQIHQLQLIEQIRHQILLLASQNADLPTSSSPSQGTLRTSANPLSTLSSHLSQQLAAAAGLAQSLASQSASISGVKQLPPIQLPQSSSGNTIIPSNSGSSPNMNILAAAVTTPSSEKVASSAGASHVSNPAVSSSSSPAFAISSLLSPASNPLLPQQASANSVFPSPLPNIGTTAEDLNSLSALAQQRKSKPPNVTAFEAKSTSDEAFFKHKCRFCAKVFGSDSALQIHLRSHTGERPFKCNICGNRFSTKGNLKVHFQRHKEKYPHIQMNPYPVPEHLDNIPTSTGIPYGMSIPPEKPVTSWLDTKPVLPTLTTSVGLPLPPTLPSLIPFIKTEEPAPIPISHSATSPPGSVKSDSGGPESATRNLGGLPEEAEGSTLPPSGGKSEESGMVTNSVPTASSSVLSSPAADCGPAGSATTFTNPLLPLMSEQFKAKFPFGGLLDSAQASETSKLQQLVENIDKKATDPNECIICHRVLSCQSALKMHYRTHTGERPFKCKICGRAFTTKGNLKTHYSVHRAMPPLRVQHSCPICQKKFTNAVVLQQHIRMHMGGQIPNTPVPDSYSESMESDTGSFDEKNFDDLDNFSDENMEDCPEGSIPDTPKSADASQDSLSSSPLPLEMSSIAALENQMKMINAGLAEQLQASLKSVENGSIEGDVLTNDSSSVGGDMESQSAGSPAISESTSSMQALSPSNSTQEFHKSPSIEEKPQRAVPSEFANGLSPTPVNGGALDLTSSHAEKIIKEDSLGILFPFRDRGKFKNTACDICGKTFACQSALDIHYRSHTKERPFICTVCNRGFSTKGNLKQHMLTHQMRDLPSQLFEPSSNLGPNQNSAVIPANSLSSLIKTEVNGFVHVSPQDSKDTPTSHVPSGPLSSSATSPVLLPALPRRTPKQHYCNTCGKTFSSSSALQIHERTHTGEKPFACTICGRAFTTKGNLKVHMGTHMWNSTPARRGRRLSVDGPMTFLGGNPVKFPEMFQKDLAARSGSGDPSSFWNQYAAALSNGLAMKANEISVIQNGGIPPIPGSLGSGNSSPVSGLTGNLERLQNSEPNAPLAGLEKMASSENGTNFRFTRFVEDSKEIVTS

SEQ ID NO: 62598 - protein, 1288 aa, Homo sapiens
MSRRKQAKPQHFQSDPEVASLPRRDGDTEKGQPSRPTKSKDAHVCGRCCAEFFELSDLLLHKKNCTKNQLVLIVNENPASPPETFSPSPPPDNPDEQMNDTVNKTGSHSSTAPSSSSSSSSSSGGGGSSSTGTSAITTSLPQLGDLTTLGNFSVINSNVIIENLQSTKVAVAQFSQEARCGGASGGKLAVPALMEQLLALQQQQIHQLQLIEQIRHQILLLASQNADLPTSSSPSQGTLRTSANPLSTLSSHLSQQLAAAAGLAQSLASQSASISGVKQLPPIQLPQSSSGNTIIPSNSGSSPNMNILAAAVTTPSSEKVASSAGASHVSNPAVSSSSSPAFAISSLLSPASNPLLPQQASANSVFPSPLPNIGTTAEDLNSLSALAQQRKSKPPNVTAFEAKSTSDEAFFKHKCRFCAKVFGSDSALQIHLRSHTGERPFKCNICGNRFSTKGNLKVHFQRHKEKYPHIQMNPYPVPEHLDNIPTSTGIPYGMSIPPEKPVTSWLDTKPVLPTLTTSVGLPLPPTLPSLIPFIKTEEPAPIPISHSATSPPGSVKSDSGGPESATRNLGGLPEEAEGSTLPPSGGKSEESGMVTNSVPTASSSVLSSPAADCGPAGSATTFTNPLLPLMSEQFKAKFPFGGLLDSAQASETSKLQQLVENIDKKATDPNECIICHRVLSCQSALKMHYRTHTGERPFKCKICGRAFTTKGNLKTHYSVHRAMPPLRVQHSCPICQKKFTNAVVLQQHIRMHMGGQIPNTPVPDSYSESMESDTGSFDEKNFDDLDNFSDENMEDCPEGSIPDTPKSADASQDSLSSSPLPLEMSSIAALENQMKMINAGLAEQLQASLKSVENGSIEGDVLTNDSSSVGGDMESQSAGSPAISESTSSMQALSPSNSTQEFHKSPSIEEKPQRAVPSEFANGLSPTPVNGGALDLTSSHAEKIIKEDSLGILFPFRDRGKFKNTACDICGKTFACQSALDIHYRSHTKERPFICTVCNRGFSTKGNLKQHMLTHQMRDLPSQLFEPSSNLGPNQNSAVIPANSLSSLIKTEVNGFVHVSPQDSKDTPTSHVPSGPLSSSATSPVLLPALPRRTPKQHYCNTCGKTFSSSSALQIHERTHTGEKPFACTICGRAFTTKGNLKVHMGTHMWNSTPARRGRRLSVDGPMTFLGGNPVKFPEMFQKDLAARSGSGDPSSFWNQYAAALSNGLAMKANEISVIQNGGIPPIPGSLGSGNSSPVSGLTGNLERLQNSEPNAPLAGLEKMASSENGTNFRFTRFVEDSKEIVTS

SEQ ID NO: 62599 - protein, 147 aa, Homo sapiens
MVHMGTHMWNSTPARRGRRLSVDGPMTFLGGNPVKFPEMFQKDLAARSGSGDPSSFWNQYAAALSNGLAMKANEISVIQNGGIPPIPGSLGSGNSSPVSGLTGNLERLQNSEPNAPLAGLEKMASSENGTNFRFTRFVEDSKEIVTS

SEQ ID NO: 62600 - protein, 1007 aa, Homo sapiens
MSRRKQRKPQQLISDCEGPSASENGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESPGHFLVAATGTAAGGGGGLILASPKLGATPLPPESTPAPPPPPPPPPPPGVGSGHLNIPLILEELRVLQQRQIHQMQMTEQICRQVLLLGSLGQTVGAPASPSELPGTGTASSTKPLLPLFSPIKPVQTSKTLASSSSSSSSSSGAETPKQAFFHLYHPLGSQHPFSAGGVGRSHKPTPAPSPALPGSTDQLIASPHLAFPSTTGLLAAQCLGAARGLEATASPGLLKPKNGSGELSYGEVMGPLEKPGGRHKCRFCAKVFGSDSALQIHLRSHTGERPYKCNVCGNRFTTRGNLKVHFHRHREKYPHVQMNPHPVPEHLDYVITSSGLPYGMSVPPEKAEEEAATPGGGVERKPLVASTTALSATESLTLLSTSAGTATAPGLPAFNKFVLMKAVEPKNKADENTPPGSEGSAISGVAESSTATRMQLSKLVTSLPSWALLTNHFKSTGSFPFPYVLEPLGASPSETSKLQQLVEKIDRQGAVAVTSAASGAPTTSAPAPSSSASSGPNQCVICLRVLSCPRALRLHYGQHGGERPFKCKVCGRAFSTRGNLRAHFVGHKASPAARAQNSCPICQKKFTNAVTLQQHVRMHLGGQIPNGGTALPEGGGAAQENGSEQSTVSGAGSFPQQQSQQPSPEEELSEEEEEEDEEEEEDVTDEDSLAGRGSESGGEKAISVRGDSEEASGAEEEVGTVAAAATAGKEMDSNEKTTQQSSLPPPPPPDSLDQPQPMEQGSSGVLGGKEEGGKPERSSSPASALTPEGEATSVTLVEELSLQEAMRKEPGESSSRKACEVCGQAFPSQAALEEHQKTHPKEGPLFTCVFCRQGFLERATLKKHMLLAHHQVQPFAPHGPQNIAALSLVPGCSPSITSTGLSPFPRKDDPTIP

SEQ ID NO: 62601 - protein, 608 aa, Homo sapiens
MSRRKQRKPQQLISDCEGPSASENGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESPGHFLVAATGTAAGGGGGLILASPKLGATPLPPESTPAPPPPPPPPPPPGVGSGHLNIPLILEELRVLQQRQIHQMQMTEQICRQVLLLGSLGQTVGAPASPSELPGTGTASSTKPLLPLFSPIKPVQTSKTLASSSSSSSSSSGAETPKQAFFHLYHPLGSQHPFSAGGVGRSHKPTPAPSPALPGSTDQLIASPHLAFPSTTGLLAAQCLGAARGLEATASPGLLKPKNGSGELSYGEVMGPLEKPGGRHKCRFCAKVFGSDSALQIHLRSHTGERPYKCNVCGNRFTTRGNLKVHFHRHREKYPHVQMNPHPVPEHLDYVITSSGLPYGMSVPPEKAEEEAATPGGGVERKPLVASTTALSATESLTLLSTSAGTATAPGLPAFNKFVLMKAVEPKNKADENTPPGSEGSAISGVAESSTATRMQLSKLVTSLPSWALLTNHFKSTGSFPFPYVPEEVHQCCHSAAACPDAPGGPDPQRWYCTP

SEQ ID NO: 62602 - protein, 1228 aa, Homo sapiens
MSRRKQAKPQHLKSDEELLPPDGAPEHAAPGEGAEDADSGPESRSGGEETSVCEKCCAEFFKWADFLEHQRSCTKLPPVLIVHEDAPAPPPEDFPEPSPASSPSERAESEAAEEAGAEGAEGEARPVEKEAEPMDAEPAGDTRAPRPPPAAPAPPTPAYGAPSTNVTLEALLSTKVAVAQFSQGARAAGGSGAGGGVAAAAVPLILEQLMALQQQQIHQLQLIEQIRSQVALMQRPPPRPSLSPAAAPSAPGPAPSQLPGLAALPLSAGAPAAAIAGSGPAAPAAFEGAQPLSRPESGASTPGGPAEPSAPAAPSAAPAPAAPAPAPAPQSAASSQPQSASTPPALAPGSLLGAAPGLPSPLLPQTSASGVIFPNPLVSIAATANALDPLSALMKHRKGKPPNVSVFEPKASAEDPFFKHKCRFCAKVFGSDSALQIHLRSHTGERPFKCNICGNRFSTKGNLKVHFQRHKEKYPHIQMNPYPVPEYLDNVPTCSGIPYGMSLPPEKPVTTWLDSKPVLPTVPTSVGLQLPPTVPGAHGYADSPSATPASRSPQRPSPASSECASLSPGLNHVESGVSATAESPQSLLGGPPLTKAEPVSLPCTNARAGDAPVGAQASAAPTSVDGAPTSLGSPGLPAVSEQFKAQFPFGGLLDSMQTSETSKLQQLVENIDKKMTDPNQCVICHRVLSCQSALKMHYRTHTGERPFKCKICGRAFTTKGNLKTHFGVHRAKPPLRVQHSCPICQKKFTNAVVLQQHIRMHMGGQIPNTPLPEGFQDAMDSELAYDDKNAETLSSYDDDMDENSMEDDAELKDAATDPAKPLLSYAGSCPPSPPSVISSIAALENQMKMIDSVMSCQQLTGLKSVENGSGESDRLSNDSSSAVGDLESRSAGSPALSESSSSQALSPAPSNGESFRSKSPGLGAPEEPQEIPLKTERPDSPAAAPGSGGAPGRAGIKEEAPFSLLFLSRERGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLKVHMGTHMWNNAPARRGRRLSVENPMALLGGDALKFSEMFQKDLAARAMNVDPSFWNQYAAAITNGLAMKNNEISVIQNGGIPQLPVSLGGSALPPLGSMASGMDKARTGSSPPIVSLDKASSETAASRPFTRFIEDNKEIGIN

SEQ ID NO: 62603 - protein, 1300 aa, Homo sapiens
MSRRKQAKPQHLKSDEELLPPDGAPEHAAPGEGAEDADSGPESRSGGEETSVCEKCCAEFFKWADFLEHQRSCTKLPPVLIVHEDAPAPPPEDFPEPSPASSPSERAESEAAEEAGAEGAEGEARPVEKEAEPMDAEPAGDTRAPRPPPAAPAPPTPAYGAPSTNVTLEALLSTKVAVAQFSQGARAAGGSGAGGGVAAAAVPLILEQLMALQQQQIHQLQLIEQIRSQVALMQRPPPRPSLSPAAAPSAPGPAPSQLPGLAALPLSAGAPAAAIAGSGPAAPAAFEGAQPLSRPESGASTPGGPAEPSAPAAPSAAPAPAAPAPAPAPQSAASSQPQSASTPPALAPGSLLGAAPGLPSPLLPQTSASGVIFPNPLVSIAATANALDPLSALMKHRKGKPPNVSVFEPKASAEDPFFKHKCRFCAKVFGSDSALQIHLRSHTGERPFKCNICGNRFSTKGNLKVHFQRHKEKYPHIQMNPYPVPEYLDNVPTCSGIPYGMSLPPEKPVTTWLDSKPVLPTVPTSVGLQLPPTVPGAHGYADSPSATPASRSPQRPSPASSECASLSPGLNHVESGVSATAESPQSLLGGPPLTKAEPVSLPCTNARAGDAPVGAQASAAPTSVDGAPTSLGSPGLPAVSEQFKAQFPFGGLLDSMQTSETSKLQQLVENIDKKMTDPNQCVICHRVLSCQSALKMHYRTHTGERPFKCKICGRAFTTKGNLKTHFGVHRAKPPLRVQHSCPICQKKFTNAVVLQQHIRMHMGGQIPNTPLPEGFQDAMDSELAYDDKNAETLSSYDDDMDENSMEDDAELKDAATDPAKPLLSYAGSCPPSPPSVISSIAALENQMKMIDSVMSCQQLTGLKSVENGSGESDRLSNDSSSAVGDLESRSAGSPALSESSSSQALSPAPSNGESFRSKSPGLGAPEEPQEIPLKTERPDSPAAAPGSGGAPGRAGIKEEAPFSLLFLSRERGKCPSTVCGVCGKPFACKSALEIHYRSHTKERPFVCALCRRGCSTMGNLKQHLLTHRLKELPSQLFDPNFALGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLKVHMGTHMWNNAPARRGRRLSVENPMALLGGDALKFSEMFQKDLAARAMNVDPSFWNQYAAAITNGLAMKNNEISVIQNGGIPQLPVSLGGSALPPLGSMASGMDKARTGSSPPIVSLDKASSETAASRPFTRFIEDNKEIGIN

SEQ ID NO: 62604 - protein, 960 aa, Homo sapiens
MSRRKQAKPQHLKSDEELLPPDGAPEHAAPGEGAEDADSGPESRSGGEETSVCEKCCAEFFKWADFLEHQRSCTKLPPVLIVHEDAPPGLPSPLLPQTSASGVIFPNPLVSIAATANALDPLSALMKHRKGKPPNVSVFEPKASAEDPFFKHKCRFCAKVFGSDSALQIHLRSHTGERPFKCNICGNRFSTKGNLKVHFQRHKEKYPHIQMNPYPVPEYLDNVPTCSGIPYGMSLPPEKPVTTWLDSKPVLPTVPTSVGLQLPPTVPGAHGYADSPSATPASRSPQRPSPASSECASLSPGLNHVESGVSATAESPQSLLGGPPLTKAEPVSLPCTNARAGDAPVGAQASAAPTSVDGAPTSLGSPGLPAVSEQFKAQFPFGGLLDSMQTSETSKLQQLVENIDKKMTDPNQCVICHRVLSCQSALKMHYRTHTGERPFKCKICGRAFTTKGNLKTHFGVHRAKPPLRVQHSCPICQKKFTNAVVLQQHIRMHMGGQIPNTPLPEGFQDAMDSELAYDDKNAETLSSYDDDMDENSMEDDAELKDAATDPAKPLLSYAGSCPPSPPSVISSIAALENQMKMIDSVMSCQQLTGLKSVENGSGESDRLSNDSSSAVGDLESRSAGSPALSESSSSQALSPAPSNGESFRSKSPGLGAPEEPQEIPLKTERPDSPAAAPGSGGAPGRAGIKEEAPFSLLFLSRERGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLKVHMGTHMWNNAPARRGRRLSVENPMALLGGDALKFSEMFQKDLAARAMNVDPSFWNQYAAAITNGLAMKNNEISVIQNGGIPQLPVSLGGSALPPLGSMASGMDKARTGSSPPIVSLDKASSETAASRPFTRFIEDNKEIGIN

SEQ ID NO: 62605 - protein, 1053 aa, Homo sapiens
MSRRKQAKPQHINSEEDQGEQQPQQQTPEFADAAPAAPAAGELGAPVNHPGNDEVASEDEATVKRLRREETHVCEKCCAEFFSISEFLEHKKNCTKNPPVLIMNDSEGPVPSEDFSGAVLSHQPTSPGSKDCHRENGGSSEDMKEKPDAESVVYLKTETALPPTPQDISYLAKGKVANTNVTLQALRGTKVAVNQRSADALPAPVPGANSIPWVLEQILCLQQQQLQQIQLTEQIRIQVNMWASHALHSSGAGADTLKTLGSHMSQQVSAAVALLSQKAGSQGLSLDALKQAKLPHANIPSATSSLSPGLAPFTLKPDGTRVLPNVMSRLPSALLPQAPGSVLFQSPFSTVALDTSKKGKGKPPNISAVDVKPKDEAALYKHKCKYCSKVFGTDSSLQIHLRSHTGERPFVCSVCGHRFTTKGNLKVHFHRHPQVKANPQLFAEFQDKVAAGNGIPYALSVPDPIDEPSLSLDSKPVLVTTSVGLPQNLSSGTNPKDLTGGSLPGDLQPGPSPESEGGPTLPGVGPNYNSPRAGGFQGSGTPEPGSETLKLQQLVENIDKATTDPNECLICHRVLSCQSSLKMHYRTHTGERPFQCKICGRAFSTKGNLKTHLGVHRTNTSIKTQHSCPICQKKFTNAVMLQQHIRMHMGGQIPNTPLPENPCDFTGSEPMTVGENGSTGAICHDDVIESIDVEEVSSQEAPSSSSKVPTPLPSIHSASPTLGFAMMASLDAPGKVGPAPFNLQRQGSRENGSVESDGLTNDSSSLMGDQEYQSRSPDILETTSFQALSPANSQAESIKSKSPDAGSKAESSENSRTEMEGRSSLPSTFIRAPPTYVKVEVPGTFVGPSTLSPGMTPLLAAQPRRQAKQHGCTRCGKNFSSASALQIHERTHTGEKPFVCNICGRAFTTKGNLKVHYMTHGANNNSARRGRKLAIENTMALLGTDGKRVSEIFPKEILAPSVNVDPVVWNQYTSMLNGGLAVKTNEISVIQSGGVPTLPVSLGATSVVNNATVSKMDGSQSGISADVEKPSATDGVPKHQFPHFLEENKIAVS

SEQ ID NO: 62606 - protein, 276 aa, Homo sapiens
MSRRKQAKPQHINSEEDQGEQQPQQQTPEFADAAPAAPAAGELGRSSLPSTFIRAPPTYVKVEVPGTFVGPSTLSPGMTPLLAAQPRRQAKQHGCTRCGKNFSSASALQIHERTHTGEKPFVCNICGRAFTTKGNLKVHYMTHGANNNSARRGRKLAIENTMALLGTDGKRVSEIFPKEILAPSVNVDPVVWNQYTSMLNGGLAVKTNEISVIQSGGVPTLPVSLGATSVVNNATVSKMDGSQSGISADVEKPSATDGVPKHQFPHFLEENKIAVS

SEQ ID NO: 62607 - protein, 616 aa, Homo sapiens
MSRRKQAKPQHINSEEDQGEQQPQQQTPEFADAAPAAPAAGELGAPVNHPGNDEVASEDEATVKRLRREETHVCEKCCAEFFSISEFLEHKKNCTKNPPVLIMNDSEGPVPSEDFSGAVLSHQPTSPGSKDCHRENGGSSEDMKEKPDAESVVYLKTETALPPTPQDISYLAKGKVANTNVTLQALRGTKVAVNQRSADALPAPVPGANSIPWVLEQILCLQQQQLQQIQLTEQIRIQVNMWASHALHSSGAGADTLKTLGSHMSQQVSAAVALLSQKAGSQGLSLDALKQAKLPHANIPSATSSLSPGLAPFTLKPDGTRVLPNVMSRLPSALLPQAPGSVLFQSPFSTVALDTSKKGKGKPPNISAVDVKPKDEAALYKHKCRSSLPSTFIRAPPTYVKVEVPGTFVGPSTLSPGMTPLLAAQPRRQAKQHGCTRCGKNFSSASALQIHERTHTGEKPFVCNICGRAFTTKGNLKVHYMTHGANNNSARRGRKLAIENTMALLGTDGKRVSEIFPKEILAPSVNVDPVVWNQYTSMLNGGLAVKTNEISVIQSGGVPTLPVSLGATSVVNNATVSKMDGSQSGISADVEKPSATDGVPKHQFPHFLEENKIAVS

SEQ ID NO: 62608 - protein, 926 aa, Homo sapiens
MVMADGPRHLQRGPVRVGFYDIEGTLGKGNFAVVKLGRHRITKTEVAIKIIDKSQLDAVNLEKIYREVQIMKMLDHPHIIKLYQVMETKSMLYLVTEYAKNGEIFDYLANHGRLNESEARRKFWQILSAVDYCHGRKIVHRDLKAENLLLDNNMNIKIADFGFGNFFKSGELLATWCGSPPYAAPEVFEGQQYEGPQLDIWSMGVVLYVLVCGALPFDGPTLPILRQRVLEGRFRIPYFMSEDCEHLIRRMLVLDPSKRLTIAQIKEHKWMLIEVPVQRPVLYPQEQENEPSIGEFNEQVLRLMHSLGIDQQKTIESLQNKSYNHFAAIYFLLVERLKSHRSSFPVEQRLDGRQRRPSTIAEQTVAKAQTVGLPVTMHSPNMRLLRSALLPQASNVEAFSFPASGCQAEAAFMEEECVDTPKVNGCLLDPVPPVLVRKGCQSLPSNMMETSIDEGLETEGEAEEDPAHAFEAFQSTRSGQRRHTLSEVTNQLVVMPGAGKIFSMNDSPSLDSVDSEYDMGSVQRDLNFLEDNPSLKDIMLANQPSPRMTSPFISLRPTNPAMQALSSQKREVHNRSPVSFREGRRASDTSLTQGIVAFRQHLQNLARTKGILELNKVQLLYEQIGPEADPNLAPAAPQLQDLASSCPQEEVSQQQESVSTLPASVHPQLSPRQSLETQYLQHRLQKPSLLSKAQNTCQLYCKEPPRSLEQQLQEHRLQQKRLFLQKQSQLQAYFNQMQIAESSYPQPSQQLPLPRQETPPPSQQAPPFSLTQPLSPVLEPSSEQMQYSPFLSQYQEMQLQPLPSTSGPRAAPPLPTQLQQQQPPPPPPPPPPRQPGAAPAPLQFSYQTCELPSAASPAPDYPTPCQYPVDGAQQSDLTGPDCPRSPGLQEAPSSYDPLALSELPGLFDCEMLDAVDPQHNGYVLVN

SEQ ID NO: 62609 - protein, 626 aa, Homo sapiens
MQRADSEQPSKRPRCDDSPRTPSNTPSAEADWSPGLELHPDYKTWGPEQVCSFLRRGGFEEPVLLKNIRENEITGALLPCLDESRFENLGVSSLGERKKLLSYIQRLVQIHVDTMKVINDPIHGHIELHPLLVRIIDTPQFQRLRYIKQLGGGYYVFPGASHNRFEHSLGVGYLAGCLVHALGEKQPELQISERDVLCVQIAGLCHDLGHGPFSHMFDGRFIPLARPEVKWTHEQGSVMMFEHLINSNGIKPVMEQYGLIPEEDICFIKEQIVGPLESPVEDSLWPYKGRPENKSFLYEIVSNKRNGIDVDKWDYFARDCHHLGIQNNFDYKRFIKFARVCEVDNELRICARDKEVGNLYDMFHTRNSLHRRAYQHKVGNIIDTMITDAFLKADDYIEITGAGGKKYRISTAIDDMEAYTKLTDNIFLEILYSTDPKLKDAREILKQIEYRNLFKYVGETQPTGQIKIKREDYESLPKEVASAKPKVLLDVKLKAEDFIVDVINMDYGMQEKNPIDHVSFYCKTAPNRAIRITKNQVSQLLPEKFAEQLIRVYCKKVDRKSLYAARQYFVQWCADRNFTKPQDGDVIAPLITPQKKEWNDSTSVQNPTRLREASKSRVQLFKDDPM

SEQ ID NO: 62610 - protein, 170 aa, Homo sapiens
MFDGRFIPLARPEVKWTHEQGSVMMFEHLINSNGIKPVMEQYGLIPEEDICFIKEQIVGPLESPVEDSLWPYKGRPENKSFLYEIVSNKRNGIDVDKWDYFARDCHHLGIQNNFDYKRFIKFARVCEVDNELRICARDKEVGNLYDMFHTRNSLHRRAYQHKVGNIIDTM

SEQ ID NO: 62611 - protein, 441 aa, Homo sapiens
MEIRLDTLSASLGRSSTLNNCNLEDKLAWYEGEAYMWHHWKPFPENPLWTCLDFQIAQVGPWDHCSSCIRHTRLKSSCSDMDLLHSWRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 62612 - protein, 205 aa, Homo sapiens
MLKRKPSNVSEKEKHQKPKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 62613 - protein, 373 aa, Homo sapiens
MLKRKPSNVSEKEKHQKPKRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 62614 - protein, 335 aa, Homo sapiens
MGSASPGLSSVSPSHLLLPPDTVSRTGLEKAAAGAVGLERRDWSPSPPATPEQGLSAFYLSYFDMLYPEDSSWAAKAPGASSREEPPEEPEQCPVIDSQAPAGSLDLVPGGLTLEEHSLEQVQSMVVGEVLKDIETACKLLNITADPMDWSPSNVQKWLLWTEHQYRLPPMGKAFQELAGKELCAMSEEQFRQRSPLGGDVLHAHLDIWKSAAWMKERTSPGAIHYCASTSEESWTDSEVDSSCSGQPIHLWQFLKELLLKPHSYGRFIRWLNKEKGIFKIEDSAQVARLWGIRKNRPAMNYDKLSRSIRQYYKKGIIRKPDISQRLVYQFVHPI

SEQ ID NO: 62615 - protein, 319 aa, Homo sapiens
MGSASPGLSSVSPSHLLLPPDTVSRTGLEKAAAGAVGLERRDWSPSPPATPEQGLSAFYLSYFDMLYPEDSSWAAKAPGASSREEPPEEPEQCPVIDSQAPAGSLDLVPGGLTLEEHSLEQVQSMVVGEVLKDIETACKLLNITADPMDWSPSNVQKWLLWTEHQYRLPPMGKAFQELAGKELCAMSEEQFRQRSPLGGDVLHAHLDIWKSASTSEESWTDSEVDSSCSGQPIHLWQFLKELLLKPHSYGRFIRWLNKEKGIFKIEDSAQVARLWGIRKNRPAMNYDKLSRSIRQYYKKGIIRKPDISQRLVYQFVHPI

SEQ ID NO: 62616 - protein, 405 aa, Homo sapiens
MAASGKTSKSEPNHVIFKKISRDKSVTIYLGNRDYIDHVSQVQPVDGVVLVDPDLVKGKKVYVTLTCAFRYGQEDIDVIGLTFRRDLYFSRVQVYPPVGAASTPTKLQESLLKKLGSNTYPFLLTFPDYLPCSVMLQPAPQDSGKSCGVDFEVKAFATDSTDAEEDKIPKKSSVRLLIRKVQHAPLEMGPQPRAEAAWQFFMSDKPLHLAVSLNKEIYFHGEPIPVTVTVTNNTEKTVKKIKAFVEQVANVVLYSSDYYVKPVAMEEAQEKVPPNSTLTKTLTLLPLLANNRERRGIALDGKIKHEDTNLASSTIIKEGIDRTVLGILVSYQIKVKLTVSGMTGRQKASEVATEVPFRLMHPQPEDPGQFSYQDANLVFEEFARHNLKDAGEAEEGKRDKNDVDE

SEQ ID NO: 62617 - protein, 405 aa, Homo sapiens
MAASGKTSKSEPNHVIFKKISRDKSVTIYLGNRDYIDHVSQVQPVDGVVLVDPDLVKGKKVYVTLTCAFRYGQEDIDVIGLTFRRDLYFSRVQVYPPVGAASTPTKLQESLLKKLGSNTYPFLLTFPDYLPCSVMLQPAPQDSGKSCGVDFEVKAFATDSTDAEEDKIPKKSSVRLLIRKVQHAPLEMGPQPRAEAAWQFFMSDKPLHLAVSLNKEIYFHGEPIPVTVTVTNNTEKTVKKIKAFVEQVANVVLYSSDYYVKPVAMEEAQEKVPPNSTLTKTLTLLPLLANNRERRGIALDGKIKHEDTNLASSTIIKEGIDRTVLGILVSYQIKVKLTVSGFLGELTSSEVATEVPFRLMHPQPEDPAKESYQDANLVFEEFARHNLKDAGEAEEGKRDKNDVDE

SEQ ID NO: 62618 - protein, 169 aa, Homo sapiens
MAASGKTSKSEPNHVIFKKISRDKSVTIYLGNRDYIDHVSQVQPVDGVVLVDPDLVKGKKVYVTLTCAFRYGQEDIDVIGLTFRRDLYFSRVQVYPPVGAASTPTKLQESLLKKLGSNTYPFLLTFPDYLPCSVMLQPAPQDSGKSCGVDFEVKAFATDSTDAEEDKIP

SEQ ID NO: 62619 - protein, 235 aa, Homo sapiens
MLQPAPQDSGKSCGVDFEVKAFATDSTDAEEDKIPKKSSVRLLIRKVQHAPLEMGPQPRAEAAWQFFMSDKPLHLAVSLNKEIYFHGEPIPVTVTVTNNTEKTVKKIKAFVEQVANVVLYSSDYYVKPVAMEEAQEKVPPNSTLTKTLTLLPLLANNRERRGIALDGKIKHEDTNLASSTIIKEGIDRTVLGILVSYQIKVKLTVSGFLGELTSSEVATEVPFRLMHPQPEDPGK

SEQ ID NO: 62620 - protein, 67 aa, Homo sapiens
MAASGKTSKSEPNHVIFKKISRDKSVSGAQVTIYLGNRDYIDHVSQVQPVDGVVLVDPDLVKGKKVS

SEQ ID NO: 62621 - protein, 210 aa, Homo sapiens
MATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKSEDDEKLKKRKERFGIVTSSAGTGTTEDTEAKKRKRAERFGIA

SEQ ID NO: 62622 - protein, 150 aa, Homo sapiens
MEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKSEDDEKLKKRKERFGIVTSSAGTGTTEDTEAKKRKRAERFGIA

SEQ ID NO: 62623 - protein, 210 aa, Homo sapiens; identical to SEQ ID NO: 62621

SEQ ID NO: 62624 - protein, 292 aa, Homo sapiens
MAGKKNVLSSLAVYAEDSEPESDGEAGIEAVGSAAEEKGGLVSDAYGEDDFSRLGGDEDGYEEEEDENSRQSDNTEAEKRDPQELVASFSERVRNMSPDEIKIPPEPPGRCSNHLQDKIQKLYERKIKEGMDMNYIIQRKKEFRNPSIYEKLIQFCAIDELGTNYPKDMFDPHGWSEDSYYEALAKAQKIEMDKLEKAKKERTKIEFVTGTKKGTTTNATSTTTTTASTAVADAQKRKSKWDSAIPVTTIAQPTILTTTATLPAVVTVTTSASGSKTTVISAVGTIVKKAKQ

SEQ ID NO: 62625 - protein, 308 aa, Homo sapiens
MAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSNHLQDKIQKLYERKIKEGMDMNYIIQRKKEFRNPSIYEKLIQFCAIDELGTNYPKDMFDPHGWSEDSYYEALAKAQKIEMDKLEKAKKERTKIEFVTGTKKGTTTNATSTTTTTASTAVADAQKRKSKWDSAIPVTTIAQPTILTTTATLPAVVTVTTSASGSKTTVISAVGTIVKKAKQ

SEQ ID NO: 62626 - protein, 168 aa, Homo sapiens
MAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSNHLQDKIQKLYERKIKEGMDMNYIIQRKKEFRNPSQGPEN

SEQ ID NO: 62627 - protein, 308 aa, Homo sapiens; identical to SEQ ID NO: 62625

SEQ ID NO: 62628 - protein, 121 aa, Homo sapiens
MSFIFEWIYNGFSSVLQFLGLYKKSGKLVFLGLDNAGKTTLLHMLKDDRLGQHVPTLHPTSEELTIAGMTFTTFDLGGHEQARRVWKNYLPAINGIVFLVDCADHSRLVESKVELNVCFVL

SEQ ID NO: 62629 - protein, 198 aa, Homo sapiens
MSFIFEWIYNGFSSVLQFLGLYKKSGKLVFLGLDNAGKTTLLHMLKDDRLGQHVPTLHPTSEELTIAGMTFTTFDLGGHEQARRVWKNYLPAINGIVFLVDCADHSRLVESKVELNALMTDETISNVPILILGNKIDRTDAISEEKLREIFGLYGQTTGKGNVTLKELNARPMEVFMCSVLKRQGYGEGFRWLSQYID

SEQ ID NO: 62630 - protein, 198 aa, Homo sapiens; identical to SEQ ID NO: 62629

SEQ ID NO: 62631 - protein, 198 aa, Homo sapiens; identical to SEQ ID NO: 62629

SEQ ID NO: 62632 - protein, 198 aa, Homo sapiens; identical to SEQ ID NO: 62629

SEQ ID NO: 62633 - protein, 117 aa, Homo sapiens
MGLSFWWTVQIILASWNPKLSLMIYCSSLLTLAPNALMTDETISNVPILILGNKIDRTDAISEEKLREIFGLYGQTTGKGNVTLKELNARPMEVFMCSVLKRQGYGEGFRWLSQYID

SEQ ID NO: 62634 - protein, 198 aa, Homo sapiens; identical to SEQ ID NO: 62629

SEQ ID NO: 62635 - protein, 115 aa, Homo sapiens
  MOD_RES (1)..(1): Any amino acid
XSFWWTVQIILASWNPKLSLMIYCSSLLTLAPNALMTDETISNVPILILGNKIDRTDAISEEKLREIFGLYGQTTGKGNVTLKELNARPMEVFMCSVLKRQGYGEGFRWLSQYID

SEQ ID NO: 62636 - protein, 155 aa, Homo sapiens
MLKDDRLGQHVPTLHPTSEELTIAGMTFTTFDLGGHEQARRVWKNYLPAINGIVFLVDCADHSRLVESKVELNALMTDETISNVPILILGNKIDRTDAISEEKLREIFGLYGQTTGKGNVTLKELNARPMEVFMCSVLKRQGYGEGFRWLSQYID

SEQ ID NO: 62637 - protein, 130 aa, Homo sapiens
MTFTTFDLGGHVQARRVWKNYLPAINGIVFLVDCADHERLLESKEELDSLMTDETIANVPILILGNKIDRPEAISEERLREMFGLYGQTTGKGSISLKELNARPLEVFMCSVLKRQGYGEGFRWMAQYID

SEQ ID NO: 62638 - protein, 198 aa, Homo sapiens
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVDCADHERLLESKEELDSLMTDETIANVPILILGNKIDRPEAISEERLREMFGLYGQTTGKGSISLKELNARPLEVFMCSVLKRQGYGEGFRWMAQYID

SEQ ID NO: 62639 - protein, 198 aa, Homo sapiens; identical to SEQ ID NO: 62638

SEQ ID NO: 62640 - protein, 103 aa, Homo sapiens
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVDCA

SEQ ID NO: 62641 - protein, 130 aa, Homo sapiens; identical to SEQ ID NO: 62637

SEQ ID NO: 62642 - protein, 170 aa, Homo sapiens
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVDCADHERLLESKEELDSLMTDETIANVPILILGNKIDRPEAISEERLREMFGLYGQTTGKGSISLKELNA

SEQ ID NO: 62643 - protein, 130 aa, Homo sapiens; identical to SEQ ID NO: 62637

SEQ ID NO: 62644 - protein, 130 aa, Homo sapiens; identical to SEQ ID NO: 62637

SEQ ID NO: 62645 - protein, 931 aa, Homo sapiens
MRALVLLGCLLASLLFSGQAELQVSASGGTEDVGNLLENHFSAGDASLEEKERALYADTAPQDKKLLLHYPDGREAESPKKTPASAASAGPDPEASLSNASATESPPPGERDDRDAAGPGEEKNGPPVASALPPGGAKGPVEEEWPEPSSGEGQGEEETGFGLPTEGTASGEAGGQAGGHELPEEVQEVQGDSLVQGAVAGTAEPKAEGASPHSEGDGVGPLNAEAEGSPGPGEEPAVPEGAPDVAAVGGESEPDIDTQASEGTEDQGEPGPAAEASAEPGGAQSVKAGDTEENQSPEMTEEDADEASSEEESGDGSGSEEEGGVPSEEESEEDSGDGASSEEAEGASEEATEPQEAGEPQEAREPQEGGDLQEAEESQEGGDPQEAEEPQEGGAPQEGGEPQEGGDPQEAREPQEAREPQEGAELPEATGTTSHRDRGAQPGPEELNTESMGSETLDMKAEEPEEGHQRESPIIVAQEETEDANEEAPLRDRSHIEKTLMLNEDKPSDDYSAVLQRLRKIYHSSIKPLEQSYKYNELRQHEITDGEITSKPMVLFLGPWSVGKSTMINYLLGLENTRYQLYTGAEPTTSEFTVLMHGPKLKTIEGIVMAADSARSFSPLEKFGQNFLEKLIGIEVPHKLLERVTFVDTPGIIENRKQQERGYPFNDVCQWFIDRADLIFVVFDPTKLDVGLELEMLFRQLKGRESQIRIILNKADNLATQMLMRVYGALFWSLAPLINVTEPPRVYVSSFWPQEYKPDTHQELFLQEEISLLEDLNQVIENRLENKIAFIRQHAIRVRIHALLVDRYLQTYKDKMTFFSDGELVFKDIVEDPDKFYIFKTILAKTNVSKFDLPNREAYKDFFGINPISSFKLLSQQCSYMGGCFLEKIERAITQELPGLLGSLGLGKNPGALNCDKTGCSETPKNRYRKH

SEQ ID NO: 62646 - protein, 473 aa, Homo sapiens
MRALVLLGCLLASLLFSGQAEETEDANEEAPLRDRSHIEKTLMLNEDKPSDDYSAVLQRLRKIYHSSIKPLEQSYKYNELRQHEITDGEITSKPMVLFLGPWSVGKSTMINYLLGLENTRYQLYTGAEPTTSEFTVLMHGPKLKTIEGIVMAADSARSFSPLEKFGQNFLEKLIGIEVPHKLLERVTFVDTPGIIENRKQQERGYPFNDVCQWFIDRADLIFVVFDPTKLDVGLELEMLFRQLKGRESQIRIILNKADNLATQMLMRVYGALFWSLAPLINVTEPPRVYVSSFWPQEYKPDTHQELFLQEEISLLEDLNQVIENRLENKIAFIRQHAIRVRIHALLVDRYLQTYKDKMTFFSDGELVFKDIVEDPDKFYIFKTILAKTNVSKFDLPNREAYKDFFGINPISSFKLLSQQCSYMGGCFLEKIERAITQELPGLLGSLGLGKNPGALNCDKTGCSETPKNRYRKH

SEQ ID NO: 62647 - protein, 431 aa, Homo sapiens
MLNEDKPSDDYSAVLQRLRKIYHSSIKPLEQSYKYNELRQHEITDGEITSKPMVLFLGPWSVGKSTMINYLLGLENTRYQLYTGAEPTTSEFTVLMHGPKLKTIEGIVMAADSARSFSPLEKFGQNFLEKLIGIEVPHKLLERVTFVDTPGIIENRKQQERGYPFNDVCQWFIDRADLIFVVFDPTKLDVGLELEMLFRQLKGRESQIRIILNKADNLATQMLMRVYGALFWSLAPLINVTEPPRVYVSSFWPQEYKPDTHQELFLQEEISLLEDLNQVIENRLENKIAFIRQHAIRVRIHALLVDRYLQTYKDKMTFFSDGELVFKDIVEDPDKFYIFKTILAKTNVSKFDLPNREAYKDFFGINPISSFKLLSQQCSYMGGCFLEKIERAITQELPGLLGSLGLGKNPGALNCDKTGCSETPKNRYRKH

SEQ ID NO: 62648 - protein, 387 aa, Homo sapiens
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGVYIKVGSASPFSTCLKMVASPDSHARCAQGQPPLLSCYDTLAPHFRVDWCNVTLVDKSVPEPADEVPTPGDGILEHDPFFCPPTEAPDRDFLVDALVTLLVPLLVALLLTLLLAYVMCCRREGRLKRDLATSDIQMVHHCTIHGNTEELRQMAASREVPRPLSTLPMFNVHTGERLPPRVDSAQVPLILDQH

SEQ ID NO: 62649 - protein, 263 aa, Homo sapiens
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGLKRDLATSDIQMVHHCTIHGNTEELRQMAASREVPRPLSTLPMFNVHTGERLPPRVDSAQVPLILDQH

SEQ ID NO: 62650 - protein, 178 aa, Homo sapiens [sequence omitted]

SEQ ID NO: 62651 - protein, 263 aa, Homo sapiens
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEVLLRHLGTPLIQMVHHCTIHGNTEELRQMAASREVPRPLSTLPMFNVHTGERLPPRVDSAQVPLILDQH

SEQ ID NO: 62652 - protein, 318 aa, Homo sapiens
MAAAAAAAAEQQSSNGPVKKSMREKAVERRSVNKEHNSNFKAGYIPIDEDRLHKTGLRGRKGNLAICVIILLFILAVINLIITLVIWAVIRIGPNGCDSMEFHESGLLRFKQVSDMGVIHPLYKSTVGGRRNENLVITGNNQPIVFQQGTTKLSVENNKTSITSDIGMQFFDPRTQNILFSTDYETHEFHLPSGVKSLNVQKASTERITSNATSDLNIKVDGRAIVRGNEGVFIMGKTIEFHMGGNMELKAENSIILNGSVMVSTTRLPSSSSGDQLGSGDWVRYKLCMCADGTLFKVQVTSQNMGCQISDNPCGNTH

SEQ ID NO: 62653 - protein, 248 aa, Homo sapiens
MAAAAAAAAEQITLVIWAVIRIGPNGCDSMEFHESGLLRFKQVSDMGVIHPLYKSTVGGRRNENLVITGNNQPIVFQQGTTKLSVENNKTSITSDIGMQFFDPRTQNILFSTDYETHEFHLPSGVKSLNVQKASTERITSNATSDLNIKVDGRAIVRGNEGVFIMGKTIEFHMGGNMELKAENSIILNGSVMVSTTRLPSSSSGDQLGSGDWVRYKLCMCADGTLFKVQVTSQNMGCQISDNPCGNTH

SEQ ID NO: 62654 - protein, 290 aa, Homo sapiens
MMPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEIKLDAAKIRLPRLPHGSYTPTGTRQKVFEICVCANGRLFLSQAGAGSTCQINTSVCL

SEQ ID NO: 62655 - protein, 289 aa, Homo sapiens
MPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEIKLDAAKIRLPRLPHGSYTPTGTRQKVFEICVCANGRLFLSQAGAGSTCQINTSVCL

SEQ ID NO: 62656 - protein, 256 aa, Homo sapiens
MMPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEVRDEKDRSSKSYSFNRPTLPITG

SEQ ID NO: 62657 - protein, 256 aa, Homo sapiens; identical to SEQ ID NO: 62656

SEQ ID NO: 62658 - protein, 437 aa, Homo sapiens
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 62659 - protein, 471 aa, Homo sapiens
MQLPRWWELGDPCAWTGQGRGTRRMSPATTGTFLLTAFLLSCADGINGTVNWKTRQANNFIISRKMAAGMKDVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGEC

SEQ ID NO: 62660 - protein, 451 aa, Homo sapiens
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVIQLVHHSAIQKSTKELRDMSKNREIAWPLSTLPVFHPVTGEIIPPLHTDNYDSTNMPLMQTQQNLPHQTQIPQQQTTGDFRLTTFQRFEVNGIPEERKLTEAMNL

SEQ ID NO: 62661 - protein, 462 aa, Homo sapiens
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQWSFAPVAQAGVQWSDLGSLQPPPPRNLPHQTQIPQQQTTGKWYP

SEQ ID NO: 62662 - protein, 291 aa, Homo sapiens
MVREQYTTATEGICIERPENQYVYKIGIYGWRKRCLYLFVLLLLIILVVNLALTIWILKVMWFSPAGMGHLCVTKDGLRLEGESEFLFPLYAKEIHSRVDSSLLLQSTQNVTVNARNSEGEVTGRLKVGPKMVEVQNQQFQINSNDGKPLFTVDEKEVVVGTDKLRVTGPEGALFEHSVETPLVRADPFQDLRLESPTRSLSMDAPRGVHIQAHAGKIEALSQMDILFHSSDGMLVLDAETVCLPKLVQGTWGPSGSSQSLYEICVCPDGKLYLSVAGVSTTCQEHNHICL

SEQ ID NO: 62663 - protein, 291 aa, Homo sapiens; identical to SEQ ID NO: 62662

SEQ ID NO: 62664 - protein, 291 aa, Homo sapiens; identical to SEQ ID NO: 62662

SEQ ID NO: 62665 - protein, 31 aa, Homo sapiens
MGINTRELFLNFTIVLITVILMWLLVRSYQY

SEQ ID NO: 62666 - protein, 31 aa, Homo sapiens; identical to SEQ ID NO: 62665

SEQ ID NO: 62667 - protein, 31 aa, Homo sapiens; identical to SEQ ID NO: 62665

SEQ ID NO: 62668 - protein, 243 aa, Homo sapiens
MGKNKQPRGQQRQGGPPAADAAGPDDMEPKKGTGAPKECGEEEPRTCCGCRFPLLLALLQLALGIAVTVVGFLMASISSSLLVRDTPFWAGIIVCLVAYLGLFMLCVSYQVDERTCIQFSMKLLYFLLSALGLTVCVLAVAFAAHHYSQLTQFTCETTLDSCQCKLPSSEPLSRTFVYRDVTDCTSVTGTFKLFLLIQMILNLVCGLVCLLACFVMWKHRYQVFYVGVRICSLTASEGPQQKI

SEQ ID NO: 62669 - protein, 140 aa, Homo sapiens
MLCVSYQVDERTCIQFSMKLLYFLLSALGLTVCVLAVAFAAHHYSQLTQFTCETTLDSCQCKLPSSEPLSRTFVYRDVTDCTSVTGTFKLFLLIQMILNLVCGLVCLLACFVMWKHRYQVFYVGVRICSLTASEGPQQKI

SEQ ID NO: 62670 - protein, 217 aa, Homo sapiens
MEPKKGTGAPKECGEEEPRTCCGCRFPLLLALLQLALGIAVTVVGFLMASISSSLLVRDTPFWAGIIVCLVAYLGLFMLCVSYQVDERTCIQFSMKLLYFLLSALGLTVCVLAVAFAAHHYSQLTQFTCETTLDSCQCKLPSSEPLSRTFVYRDVTDCTSVTGTFKLFLLIQMILNLVCGLVCLLACFVMWKHRYQVFYVGVRICSLTASEGPQQKI

SEQ ID NO: 62671 - protein, 128 aa, Homo sapiens
MGKNKQPRGQQRQGGPPAADAAGPDDMEPKKGTGAPKECGEEEPRTCCGCRFPLLLALLQLALGIAVTVVGFLMASISSSLLVRDTPFWAGIIVCLVAYLGLFMLCVSYQVDERTCIQFSMKIHCHDF

SEQ ID NO: 62672 - protein, 120 aa, Homo sapiens
MLCVSYQVDERTCIQFSMKLLYFLLSALGLTVCVLAVAFAAHHYSQLTQFTCETTLDSCQCKLPSSEPLSRTFVYRDVTDCTSVTGTFKLFLLIQMILNLVCGLVCLLACFVMWKHRYQV

SEQ ID NO: 62673 - protein, 140 aa, Homo sapiens; identical to SEQ ID NO: 62669

SEQ ID NO: 62674 - protein, 763 aa, Homo sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGRWYKHFKKTKDMMVEMDSLSELSQQGANHVNFGQQPVPGNTAEQPPSPAQLSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQGLLSEILRKEEDPKTASQSLLVNLRAMQNFLQLPEAERDRIYQDERERSLNAASAMGPAPLISTPPSRPPQVKTATIATERNGKPENNTMNINASIYDEIQQEMKRAKVSQALFAKVAATKSQGWLCELLRWKEDPSPENRTLWENLSMIRRFLSLPQPERDAIYEQESNAVHHHGDRPPHIIHVPAEQIQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 62675 - protein, 116 aa, Homo sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALL

SEQ ID NO: 62676 - protein, 224 aa, Homo sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTY

SEQ ID NO: 62677 - protein, 71 aa, Homo sapiens
MDHLNEATQGKEHSEMSNNVSDPKGPPAKIARLEQNGSPLGRGRLGSTGAKMQGVPLKHSGHLMKTNLRKG

SEQ ID NO: 62678 - protein, 8 aa, Homo sapiens
MDHLNEAT

SEQ ID NO: 62679 - protein, 172 aa, Homo sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHR

SEQ ID NO: 62680 - protein, 763 aa, Homo sapiens; identical to SEQ ID NO: 62674

SEQ ID NO: 62681 - protein, 130 aa, Homo sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKG

SEQ ID NO: 62682 - protein, 795 aa, Homo sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGRWYKHFKKTKDMMVEMDSLSELSQQGANHVNFGQQPVPGNTAEQPPSPAQLSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQGLLSEILRKEEDPKTASQSLLVNLRAMQNFLQLPEAERDRIYQDERERSLNAASAMGPAPLISTPPSRPPQVKTATIATERNGKPENNTMNINASIYDEIQQEMKRAKVSQALFAKVAATKSQGWLCELLRWKEDPSPENRTLWENLSMIRRFLSLPQPERDAIYEQESNAVHHHGDRPPHIIHVPAEQIQSPSPTTLGKGESRGVFLPGLPTPAPWLGAAPQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 62683 - protein, 733 aa, Homo sapiens
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 62684 - protein, 733 aa, Homo sapiens; identical to SEQ ID NO: 62683

SEQ ID NO: 62685 - protein, 615 aa, Homo sapiens
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 62686 - protein, 733 aa, Homo sapiens; identical to SEQ ID NO: 62683

SEQ ID NO: 62687 - protein, 915 aa, Homo sapiens
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRRDWGDHGRREDDRSWQGTADGGMMDRDHKRWQGGERSMSGHSGPGHMMNRGGMSGRGSFAPGGASRGHPIPHGGMQGGFGGQSRGSRPSDARFTRRY

SEQ ID NO: 62688 - protein, 747 aa, Homo sapiens
MKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFAPGGASRGHPIPHGGMQGGFGGQSRGSRPSDARFTRRY

SEQ ID NO: 62689 - protein, 848 aa, Homo sapiens
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFAPGGASRGHPIPHGGMQGGFGGQSRGSRPSDARFTRRY

SEQ ID NO: 62690 - protein, 759 aa, Homo sapiens
MKVVILTKLKLPPRETRKHQRGLAKIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFAPGGASRGHPIPHGGMQGGFGGQSRGSRPSDARFTRRY

SEQ ID NO: 62691 - protein, 812 aa, Homo sapiens
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFAPGGASRGHPIPHGGMQGGFGGQSRGSRPSDARFTRRY

SEQ ID NO: 62692 - protein, 953 aa, Homo sapiens
MAETLPGSGDSGPGTASLGPGVAETGTRRLSELRVIDLRAELKKRNLDTGGNKSVLMERLKKAVKEEGQDPDEIGIELEATSKKSAKRCVKGLKMEEEGTEDNGLEDDSRDGQEDMEASLENLQNMGMMDMSVLDETEVANSSAPDFGEDGTDGLLDSFCDSKEYVAAQLRQLPAQPPEHAVDGEGFKNTLETSSLNFKVTPDIEESLLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSFKEEKDIKPIIKDEKGRVGSGSGRNLWVSGLSSTTRATDLKNLFSKYGKVVGAKVVTNARSPGARCYGFVTMSTSDEATKCISHLHRTELHGRMISVEKAKNEPAGKKLSDRKECEVKKEKLSSVDRHHSVEIKIEKTVIKKEEKIEKKEEKKPEDIKKEEKDQDELKPGPTNRSRVTKSGSRGMERTVVMDKSKGEPVISVKTTSRSKERSSKSQDRKSESKEKRDILSFDKIKEQRERERQRQREREIRETERRREREQREREQRLEAFHERKEKARLQRERLQLECQRQRLERERMERERLERERMRVERERRKEQERIHREREELRRQQEQLRYEQERRPGRRPYDLDRRDDAYWPEGKRVAMEDRYRADFPRPDHRFHDFDHRDRGQYQDHAIDRREGSRPMMGDHRDGQHYGDDRHGHGGPPERHGRDSRDGWGGYGSDKRLSEGRGLPPPPRGGRDWGEHNQRLEEHQARAWQGAMDAGAASREHARWQGGERGLSGPSGPGHMASRGGVAGRGGFAQGGHSQGHVVPGGGLEGGGVASQDRGSRVPHPHPHPPPYPHFTRRY

SEQ ID NO: 62693 - protein, 510 aa, Homo sapiens
MAETLPGSGDSGPGTASLGPGVAETGTRRLSELRVIDLRAELKKRNLDTGGNKSVLMERLKKAVKEEGQDPDEIGIELEATSKKSAKRCVKGLKMEEEGTEDNGLEDDSRDGQEDMEASLENLQNMGMMDMSVLDETEVANSSAPDFGEDGTDGLLDSFCDSKEYVAAQLRQLPAQPPEHAVGNLETRQDVPTSSSLRVSVAAVPVPHLSVENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSFKEEKDIKPIIKDEKGRVGSGSGRNLWVSGLSSTTRATDLKNLFSKYGKVVGAKVVTNARSPGARCYGFVTMSTSDEATKCISHLHRTELHGRMISVEKAKNEPAGKKLSDRKECEVKKEKLSSVDR

SEQ ID NO: 62694 - protein, 261 aa, Homo sapiens
MAETLPGSGDSGPGTASLGPGVAETGTRRLSELRVIDLRAELKKRNLDTGGNKSVLMERLKKAVKEEGQDPDEIGIELEATSKKSAKRCVKAPSPEARDSKEDGRKFDFDACNEVPPAPKESSTSEGADQKMSSFKEEKDIKPIIKDEKGRVGSGSGRNLWVSGLSSTTRATDLKNLFSKYGKVVGAKVVTNARSPGARCYGFVTMSTSDEATKCISHLHRTELHGRMISVEKAKNEPAGKKLSDRKECEVKKEKLSSVDR

SEQ ID NO: 62695 - protein, 406 aa, Homo sapiens
MAETLPGSGDSGPGTASLGPGVAETGTRRLSELRVIDLRAELKKRNLDTGGNKSVLMERLKKAVKEEGQDPDEIGIELEATSKKSAKRCVKGLKMEEEGTEDNGLEVENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSFKEEKDIKPIIKDEKGRVGSGSGRNLWVSGLSSTTRATDLKNLFSKYGKVVGAKVVTNARSPGARCYGFVTMSTSDEATKCISHLHRTELHGRMISVEKAKNEPAGKKLSDRKECEVKKEKLSSVDR

SEQ ID NO: 62696 - protein, 201 aa, Homo sapiens
MAETGTRRLSELRVIDLRAELKKRNLDTGGNKSVLMERLKKAVKEEGQDPDEIGIELEATSKKSAKRCVKGLKMEEEGTEDNGLEDDSRDGQEDMEASLENLQNMGMMDMSVLDETEVANSSAPDFGEDGTDGLLDSFCDSKEYVAAQLRQLPAQPPEHAVDGEGFKNTLETSSLNFKVTPDIEESLLEPGTDKRNTTVMV

SEQ ID NO: 62697 - protein, 606 aa, Homo sapiens
MKVRSAGGDGDALCVTEEDLAGDDEDMPTFPCTQKGRPGPRCSRCQKNLSLHTSVRILYLFLALLLVAVAVLASLVFRKVDSLSEDISLTQSIYDKKLVLMQKNLQGLDPKALNNCSFCHEAGQLGPEIRKLQEELEGIQKLLLAQEVQLDQTLQAQEVLSTTSRQISQEMGSCSFSIHQVNQSLGLFLAQVRGWQATTAGLDLSLKDLTQECYDVKAAVHQINFTVGQTSEWIHGIQRKTDEETLTLQKIVTDWQNYTRLFSGLRTTSTKTGEAVKNIQATLGASSQRISQNSESMHDLVLQVMGLQLQLDNISSFLDDHEENMHDLQYHTHYAQNRTVERFESLEGRMASHEIEIGTIFTNINATDNHVHSMLKYLDDVRLSCTLGFHTHAEELYYLNKSVSIMLGTTDLLRERFSLLSARLDLNVRNLSMIVEEMKAVDTQHGEILRNVTILRGAPGPPGPRGFKGDMGVKGPVGGRGPKGDPGSLGPLGPQGPQGQPGEAGPVGERGPVGPRGFPGLKGSKGSFGTGGPRGQPGPKGDIGPPGPEGPPGSPGPSGPQGKPGIAGKTGSPGQRGAMGPKGEPGIQGPPGLPGPPGPPGSQSFY

SEQ ID NO: 62698 - protein, 466 aa, Homo sapiens
MKVRSAGGDGDALCVTEEDLAGDDEDMPTFPCTQKGRPGPRCSRCQKNLSLHTSVRILYLFLALLLVAVAVLASLVFRKVDSLSEDISLTQSIYDKKLVLMQKNLQGLDPKALNNCSFCHEAGQLGPEIRKLQEELEGIQKLLLAQEVQLDQTLQAQEVLSTTSRQISQEMGSCSFSIHQVNQSLGLFLAQVRGWQATTAGLDLSLKDLTQECYDVKAAVHQINFTVGQTSEWIHGIQRKTDEETLTLQKIVTDWQNYTRLFSGLRTTSTKTGEAVKNIQATLGASSQRISQNSESMHDLVLQVMGLQLQLDNISSFLDDHEENMHDLQYHTHYAQNRTVERFESLEGRMASHEIEIGTIFTNINATDNHVHSMLKYLDDVRLSCTLGFHTHAEELYYLNKSVSIMLGTTDLLRERFSLLSARLDLNVRNLSMIVEEMKAVDTQHGEILRNVTILRGHTLFSHNRI

SEQ ID NO: 62699 - protein, 335 aa, Homo sapiens
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 62700 - protein, 509 aa, Homo sapiens
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQEKCYLFWSSSKKGSKDKEAIQAYSESLMTSAPKGSVLQEAKL

SEQ ID NO: 62701 - protein, 506 aa, Homo sapiens
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQGPEDTVSQPGLAAGPDRPPSPYTPLLPDSPSGQPPSPTA

SEQ ID NO: 62702 - protein, 409 aa, Homo sapiens
MGCSAKARWAAGALGVAGLLCAVLGAVMIVMVPSLIKQQVLKGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQEKCYLFWSSSKKGSKDKEAIQAYSESLMTSAPKGSVLQEAKL

SEQ ID NO: 62703 - protein, 552 aa, Homo sapiens
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQVGAGQRAARADSHSLACWGKGASDRTLWPTAAWSPPPAAVLRLCRSGSGHCWGLRSTLASFACRVATTLPVLEGLGPSLGGGTGS

SEQ ID NO: 62704 - protein, 516 aa, Homo sapiens [sequence omitted]

SEQ ID NO: 62705 - protein, 512 aa, Homo sapiens
MNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQVGAGQRAARADSHSLACWGKGASDRTLWPTAAWSPPPAAVLRLCRSGSGHCWGLRSTLASFACRVATTLPVLEGLGPSLGGGTGGL

SEQ ID NO: 62706 - protein, 146 aa, Homo sapiens
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLVRLP

SEQ ID NO: 62707 - protein, 481 aa, Homo sapiens
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKEKCYLFWSSSKKGSKDKEAIQAYSESLMTSAPKGSVLQEAKL

SEQ ID NO: 62708 - protein, 478 aa, Homo sapiens
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 62709 - protein, 569 aa, Homo sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIAGSLVPLLLLFLGLACCACCCWAPRSDLKDRPARDGATVSRMKLQVWGTLTSLGSTLPCRSLSSHKLPWVTASSSRPLPAGPLMTPSHPILSLERQMRFLPTVCHPKKGWSLWPRQGRQRPAWLQVLSRPLRTPPRHSPSRAPPA

SEQ ID NO: 62710 - protein, 870 aa, Homo sapiens
MEGAGPRGAGPARRRGAGGPPSPLLPSLLLLLLLWMLPDTVAPQELNPRGRNVCRAPGSQVPTCCAGWRQQGDECGIAVCEGNSTCSENEVCVRPGECRCRHGYFGANCDTKCPRQFWGPDCKELCSCHPHGQCEDVTGQCTCHARRWGARCEHACQCQHGTCHPRSGACRCEPGWWGAQCASACYCSATSRCDPQTGACLCHAGWWGRSCNNQCACNSSPCEQQSGRCQCRERTFGARCDRYCQCFRGRCHPVDGTCACEPGYRGKYCREPCPAGFYGLGCRRRCGQCKGQQPCTVAEGRCLTCEPGWNGTKCDQPCATGFYGEGCSHRCPPCRDGHACNHVTGKCTRCNAGWIGDRCETKCSNGTYGEDCAFVCADCGSGHCDFQSGRCLCSPGVHGPHCNVTCPPGLHGADCAQACSCHEDTCDPVTGACHLETNQRKGVMGAGALLVLLVCLLLSLLGCCCACRGKDPTRRPRPRRELSLGRKKAPHRLCGRFSRISMKLPRIPLRRQKLPKVVVAHHDLDNTLNCSFLEPPSGLEQPSPSWSSRASFSSFDTTDEGPVYCVPHEEAPAESRDPEVPTVPAEAPAPSPVPLTTPASAEEAIPLPASSDSERSASSVEGPGGALYARVARREARPARARGEIGGLSLSPSPERRKPPPPDPATKPKVSWIHGKHSAAAAGRAPSPPPPGSEAAPSPSKRKRTPSDKSAHTVEHGSPRTRDPTPRPPGLPEEATALAAPSPPRARARAAPRPLGAHGRRRSPAKRAEAASMLAADVRGKTRSLGRAEVALGAQGPREKPAPPQKAKRSVPPASPARAPPATETPGPEKAATDLPAPETPRKKTPIQKPPRKKSREAAGELGRAGAPTL

SEQ ID NO: 62711 - protein, 830 aa, Homo sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIAGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPEEAEAPESFPAAASPGDSATGHRRPPLGGRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 62712 - protein, 744 aa, Homo sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCSGSRDTALIAGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPEEAEAPESFPAAASPGDSATGHRRPPLGGRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 62713 - protein, 569 aa, Homo sapiens; identical to SEQ ID NO: 62709

SEQ ID NO: 62714 - protein, 864 aa, Homo sapiens
MEGAGPRGAGPARRRGAGGPPSPLLPSLLLLLLLWMLPDTVAPQELNPRGRNVCRAPGSQVPTCCAGWRQQGDECGIAVCEGNSTCSENEVCVRPGECRCRHGYFGANCDTKCPRQFWGPDCKELCSCHPHGQCEDVTGQCTCHARRWGARCEHACQCQHGTCHPRSGACRCEPGWWGAQCASACYCSATSRCDPQTGACLCHAGWWGRSCNNQCACNSSPCEQQSGRCQCRERTFGARCDRYCQCFRGRCHPVDGTCACEPGYRGKYCREPCPAGFYGLGCRRRCGQCKGQQPCTVAEGRCLTCEPGWNGTKCDQPCATGFYGEGCSHRCPPCRDGHACNHVTGKCTRCNAGWIGDRCETKCSNGTYGEDCAFVCADCGSGHCDFQSGRCLCSPGVHGPHCNVTCPPGLHGADCAQACSCHEDTCDPVTGACHLETNQRKGVMGAGALLVLLVCLLLSLLGCCCACRGKDPTRRELSLGRKKAPHRLCGRFSRISMKLPRIPLRRQKLPKVVVAHHDLDNTLNCSFLEPPSGLEQPSPSWSSRASFSSFDTTDEGPVYCVPHEEAPAESRDPEVPTVPAEAPAPSPVPLTTPASAEEAIPLPASSDSERSASSVEGPGGALYARVARREARPARARGEIGGLSLSPSPERRKPPPPDPATKPKVSWIHGKHSAAAAGRAPSPPPPGSEAAPSPSKRKRTPSDKSAHTVEHGSPRTRDPTPRPPGLPEEATALAAPSPPRARARARPGLLEPTDAGGPPRSAPAASMLAADVRGKTRSLGRAEVALGAQGPREKPAPPQKAKRSVPPASPARAPPATETPGPEKAATDLPAPETPRKKTPIQKPPRKKSREAAGELGRAGAPTL

SEQ ID NO: 62715 - protein, 865 aa, Homo sapiens
MEGAGPRGAGPARRRGAGGPPSPLLPSLLLLLLLWMLPDTVAPQELNPRGRNVCRAPGSQVPTCCAGWRQQGDECGIAVCEGNSTCSENEVCVRPGECRCRHGYFGANCDTKCPRQFWGPDCKELCSCHPHGQCEDVTGQCTCHARRWGARCEHACQCQHGTCHPRSGACRCEPGWWGAQCASACYCSATSRCDPQTGACLCHAGWWGRSCNNQCACNSSPCEQQSGRCQCRERTFGARCDRYCQCFRGRCHPVDGTCACEPGYRGKYCREPCPAGFYGLGCRRRCGQCKGQQPCTVAEGRCLTCEPGWNGTKCDQPCATGFYGEGCSHRCPPCRDGHACNHVTGKCTRCNAGWIGDRCETKCSNGTYGEDCAFVCADCGSGHCDFQSGRCLCSPGVHGPHCNVTCPPGLHGADCAQACSCHEDTCDPVTGACHLETNQRKGVMGAGALLVLLVCLLLSLLGCCCACRGKDPTRRELSLGRKKAPHRLCGRFSRISMKLPRIPLRRQKLPKVVVAHHDLDNTLNCSFLEPPSGLEQPSPSWSSRASFSSFDTTDEGPVYCVPHEEAPAESRDPEVPTVPAEAPAPSPVPLTTPASAEEAIPLPASSDSERSASSVEGPGGALYARVARREARPARARGEIGGLSLSPSPERRKPPPPDPATKPKVSWIHGKHSAAAAGRAPSPPPPGSEAAPSPSKRKRTPSDKSAHTVEHGSPRTRDPTPRPPGLPEEATALAAPSPPRARARAAPRPLGAHGRRRSPAKRAEAASMLAADVRGKTRSLGRAEVALGAQGPREKPAPPQKAKRSVPPASPARAPPATETPGPEKAATDLPAPETPRKKTPIQKPPRKKSREAAGELGRAGAPTL

SEQ ID NO: 62716 - protein, 575 aa, Homo sapiens
MHKEAEMLIGPQLDEKRWGWRLGDGSAAPPFLPQALSFLLLLPLASALQPTPLPFQELRLVGGPSRCRGRLEVMHGGSWGSVCDDDWDVVDANVVCRQLGCGLALPVPRPLAFGQGRGPILLDNVECRGQEAALSECGSRGWGVHNCFHYEDVAVLCDEFLPTQPPTRKMLTSRAPPTTLPNGKSEGSVRLVGGANLCQGRVEILHSGLWGTVCDDDWGLPDAAVVCRQLGCGAAMAATTNAFFGYGTGHILLDNVHCEGGEPRLAACQSLGWGVHNCGHHEDAGALCAGLGPPTLTALPSSATREDWAWQTDPSATGVGPQPSRETALLTTAAWAAGKKSGRLRLVGGPGPCRGRVEVLHAGGWGTVCDDDWDFADARVACREAGCGPALGATGLGHFGYGRGPVLLDNVGCAGTEARLSDCFHLGWGQHNCGHHEDAGALCAGPEELGLQVQQDGSETTRVPTPRPRDGHLRLVNGAHRCEGRVELYLGQRWGTVCDDAWDLRAAGVLCRQLGCGQALAAPGEAHFGPGRGPILLDNVKCRGEESALLLCSHIRWDAHNCDHSEDASVLCQPS

SEQ ID NO: 62717 - protein, 282 aa, Homo sapiens
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNISEELDNLIKMNKSLNRNQGLDSLFRANPKVEEREKRAKSLESLIYMSTRTDKDGKGIQSLGSPIKVNQRTDKNEK

SEQ ID NO: 62718 - protein, 688 aa, Homo sapiens
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRISDRNDAAKTYKANTLDNQLTNRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNIRSQDLDNIVKVATSLQRSDKGEELDNLIKMNKSLNRNQGLDSLFRANPKVEEREKRAKSLESLIYMSTRTDKDGKGIQSLGSPIKVNQRTDKNEKGRQNLESVAKVNARMNKTSRRSEDLDNATEVNPKGHENTTGKKDLDGLIKVDPETNKNITRGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 62719 - protein, 668 aa, Homo sapiens
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRISDRNDAAKTYKANTLDNQLTNRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNISEELDNLIKMNKSLNRNQGLDSLFRANPKVEEREKRAKSLESLIYMSTRTDKDGKGIQSLGSPIKVNQRTDKNEKGRQNLESVAKVNARMNKTSRRSEDLDNATEVNPKGHENTTGKKDLDGLIKVDPETNKNITRGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 62720 - protein, 646 aa, Homo sapiens
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRISDRNDAAKTYKANTLDNQLTNRSMSMFRSLEVTKLQPGGSLNANTSNTIASTSATTPVKKKREPGVHPPIPPKPSSPVSSPNQLRQDNRQIHPPKPGVYTETNRSAERNIRSQDLDNIVKVATSLQRSDKGEELDNLIKMNKSLNRNQGLDSLFRANPKVEEREKRAKSLESLIYMSTRTDKDGKGIQSLGSPIKVNQRTDKNEKGRQNLESVAKVNARMNKTSRRSEDLDNATEVNPKGHENTTGGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 62721 - protein, 715 aa, Homo sapiens
MARELYHEEFARAGKQAGLQVWRIEKLELVPVPQSAHGDFYVGDAYLVLHTAKTSRGFTYHLHFWLGKECSQDESTAAAIFTVQMDDYLGGKPVQNRELQGYESNDFVSYFKGGLKYKAGGVASGLNHVLTNDLTAKRLLHVKGRRVVRATEVPLSWDSFNKGDCFIIDLGTEIYQWCGSSCNKYERLKANQVATGIRYNERKGRSELIVVEEGSEPSELIKVLGEKPELPDGGDDDDIIADISNRKMAKLYMVSDASGSMRVTVVAEENPFSMAMLLSEECFILDHGAAKQIFVWKGKDANPQERKAAMKTAEEFLQQMNYSKNTQIQVLPEGGETPIFKQFFKDWRDKDQSDGFGKVYVTEKVAQIKQIPFDASKLHSSPQMAAQHNMVDDGSGKVEIWRVENNGRIQVDQNSYGEFYGGDCYIILYTYPRGQIIYTWQGANATRDELTTSAFLTVQLDRSLGGQAVQIRVSQGKEPVHLLSLFKDKPLIIYKNGTSKKGGQAPAPPTRLFQVRRNLASITRIVEVDVDANSLNSNDVFVLKLPQNSGYIWVGKGASQEEEKGAEYVASVLKCKTLRIQEGEEPEEFWNSLGGKKDYQTSPLLETQAEDHPPRLYGCSNKTGRFVIEEIPGEFTQDDLAEDDVMLLDAWEQIFIWIGKDANEVEKKESLKSAKMYLETDPSGRDKRTPIVIIKQGHEPPTFTGWFLGWDSSKW

SEQ ID NO: 62722 - protein, 468 aa, Homo sapiens
MAKLYMVSDASGSMRVTVVAEENPFSMAMLLSEECFILDHGAAKQIFVWKGKDANPQERKAAMKTAEEFLQQMNYSKNTQIQVLPEGGETPIFKQFFKDWRDKDQSDGFGKVYVTEKVAQIKQIPFDASKLHSSPQMAAQHNMVDDGSGKVEIWRVENNGRIQVDQNSYGEFYGGDCYIILYTYPRGQIIYTWQGANATRDELTTSAFLTVQLDRSLGGQAVQIRVSQGKEPVHLLSLFKDKPLIIYKNGTSKKGGQAPAPPTRLFQVRRNLASITRIVEVDVDANSLNSNDVFVLKLPQNSGYIWVGKGASQEEEKGAEYVASVLKCKTLRIQEGEEPEEFWNSLGGKKDYQTSPLLETQAEDHPPRLYGCSNKTGRFVIEEIPGEFTQDDLAEDDVMLLDAWEQIFIWIGKDANEVEKKESLKSAKMYLETDPSGRDKRTPIVIIKQGHEPPTFTGWFLGWDSSKW

SEQ ID NO: 62723 - protein, 468 aa, Homo sapiens; identical to SEQ ID NO: 62722

SEQ ID NO: 62724 - protein, 1287 aa, Homo sapiens
MEPIYPFARPQMNTRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCGKLLSLRVHITSRESLDSVEFDLHWAAVTLANNFKCTPVKPIPIIPTALARNLSSNLNISQVQGTYKYGYLTMDETRKLLLLLESDPKVYSLPLVGIWLSGITHIYSPQVWACCLRYIFNSSVQERVFSESGNFIIVLYSMTHKEPEFYECFPCDGKIPDFRFQLLTSKETLHLFKNVEPPDKNPIRCELSAESQNAETEFFSKASKNFSIKRSSQKLSSGKMPIHDHDSGVEDEDFSPRPIPSPHPVSQKISKIQPSVPELSLVLDGNFIESNPLPTPLEMVNNENPPLINHLEHLKPLQPQLYDEKHSPEVEAGEPSLRGIPNQLNQDKPALLRHCKVRQPPAYKKGNPHTRNSIKPSSHNGPSHDIFEKLQTVSAGNVQNEEYPIRPSTLNSRQSSLAPQSQPHDFVFSPHNSGRPMELQIPTPPLPSYCSTNVCRCCQHHSHIQYSPLNSWQGANTVGSIQDVQSEALQKHSLFHPSGCPALYCNAFCSSSSPIALRPQGDMGSCSPHSNIEPSPVARPPSHMDLCNPQPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVSNSSLVVRKEPDVPVFFPSGQLAESVSMCLQTGPTGGASNNSETSEEPKIEHVMQPLLHQPSDNQKIYQDLLGQVNHLLNSSSKETEQPSTKAVIISHECTRTQNVYHTKKKTHHSRLVDKDCVLNATLKQLRSLGVKIDSPTKVKKNAHNVDHASVLACISPEAVISGLNCMSFANVGMSGLSPNGVDLSMEANAIALKYLNENQLSQLSVTRSNQNNCDPFSLLHINTDRSTVGLSLISPNNMSFATKKYMKRYGLLQSSDNSEDEEEPPDNADSKSEYLLNQNLRSIPEQLGGQKEPSKNDHEIINCSNCESVGTNADTPVLRNITNEVLQTKAKQQLTEKPAFLVKNLKPSPAVNLRTGKAEFTQHPEKENEGDITIFPESLQPSETLKQMNSMNSVGTFLDVKRLRQLPKLF

SEQ ID NO: 62725 - protein, 1287 aa, Homo sapiens; identical to SEQ ID NO: 62724

SEQ ID NO: 62726 - protein, 1287 aa, Homo sapiens; identical to SEQ ID NO: 62724

SEQ ID NO: 62727 - protein, 210 aa, Homo sapiens
QLYDEKHSPEVEAGEPSLRGIPNQLNQDKPALLRHCKPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVS

SEQ ID NO: 62728 - protein, 1288 aa, Homo sapiens
MEPIYPFARPQMNTRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCGKLLSLRVHITSRESLDSVEFDLHWAAVTLANNFKCTPVKPIPIIPTALARNLSSNLNISQVQGTYKYGYLTMDETRKLLLLLESDPKVYSLPLVGIWLSGITHIYSPQVWACCLRYIFNSSVQERVFSESGNFIIVLYSMTHKEPEFYECFPCDGKIPDFRFQLLTSKETLHLFKNVEPPDKNPIRCELSAESQNAETEFFSKASKNFSIKRSSQKLSSGKMPIHDHDSGVEDEDFSPRPIPSPHPVSQKISKIQPSVPELSLVLDGNFIESNPLPTPLEMVNNENPPLINHLEHLKPLQPQLYDEKHSPEVEAGEPSLRGIPNQLNQDKPALLRHCKVRQPPAYKKGNPHTRNSIKPSSHNGPSHDIFEKLQTVSAGNVQNEEYPIRPSTLNSRQSSLAPQSQPHDFVFSPHNSGRPMELQIPTPPLPSYCSTNVCRCCQHHSHIQYSPLNSWQGANTVGSIQDVQSEALQKHSLFHPSGCPALYCNAFCSSSSPIALRPQGDMGSCSPHSNIEPSPVARPPSHMDLCNPQPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVSNSSSLVVRKEPDVPVFFPSGQLAESVSMCLQTGPTGGASNNSETSEEPKIEHVMQPLLHQPSDNQKIYQDLLGQVNHLLNSSSKETEQPSTKAVIISHECTRTQNVYHTKKKTHHSRLVDKDCVLNATLKQLRSLGVKIDSPTKVKKNAHNVDHASVLACISPEAVISGLNCMSFANVGMSGLSPNGVDLSMEANAIALKYLNENQLSQLSVTRSNQNNCDPFSLLHINTDRSTVGLSLISPNNMSFATKKYMKRYGLLQSSDNSEDEEEPPDNADSKSEYLLNQNLRSIPEQLGGQKEPSKNDHEIINCSNCESVGTNADTPVLRNITNEVLQTKAKQQLTEKPAFLVKNLKPSPAVNLRTGKAEFTQHPEKENEGDITIFPESLQPSETLKQMNSMNSVGTFLDVKRLRQLPKLF

SEQ ID NO: 62729 - protein, 201 aa, Homo sapiens
MSFATLRPAPPGRYLYPEVSPLSEDEDRGSDSSGSDEKPCRVHAARCGLQGARRRAGGRRAGGGGPGGRPGREPRQRHTANARERDRTNSVNTAFTALRTLIPTEPADRKLSKIETLRLASSYISHLGNVLLAGEACGDGQPCHSGPAFFHAARAGSPPPPPPPPPARDGENTQPKQICTFCLSNQRKLSKDRDRKTAIRS

SEQ ID NO: 62730 - protein, 213 aa, Homo sapiens
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 62731 - protein, 301 aa, Homo sapiens
MAMLVLVPGRVMRPLGGQLWRFLPRGLEFWGPAEGTARVLLRQFCARQAEAWRASGRPGYCLGTRPLSTARPPPPWSQKGPGDSTRPSKPGPVSWKSLAITFAIGGALLAGMKHVKKEKAEKLEKERQRHIGKPLLGGPFSLTTHTGERKTDKDYLGQWLLIYFGFTHCPDVCPEELEKMIQVVDEIDSITTLPDLTPLFISIDPERDTKEAIANYVKEFSPKLVGLTGTREEVDQVARAYRVYYSPGPKDEDEDYIVDHTIIMYLIGPDGEFLDYFGQNKRKGEIAASIATHMRPYRKKS

SEQ ID NO: 62732 - protein, 270 aa, Homo sapiens
MAMLVLVPGRVMRPLGGQLWRFLPRGLEFWGPAEGTARVLLRQFCARQAEAWRASGRPGYCLGTRPLSTARPPPPWSQKGPGDSTRPSKPGPVSWKSLAITFAIGGALLAGMKHVKKEKAEKLEKERQRHIGKPLLGGPFSLTTHTGERKTDKDYLDSITTLPDLTPLFISIDPERDTKEAIANYVKEFSPKLVGLTGTREEVDQVARAYRVYYSPGPKDEDEDYIVDHTIIMYLIGPDGEFLDYFGQNKRKGEIAASIATHMRPYRKKS

SEQ ID NO: 62733 - protein, 266 aa, Homo sapiens
MLLLTRSPTAWHRLSQLKPRVLPGTLGGQALHLRSWLLSRQGPAETGGQGQPQGPGLRTRLLITGLFGAGLGGAWLALRAEKERLQQQKRTEALRQAAVGQGDFHLLDHRGRARCKADFRGQWVLMYFGFTHCPDICPDELEKLVQVVRQLEAEPGLPPVQPVFITVDPERDDVEAMARYVQDFHPRLLGLTGSTKQVAQASHSYRVYYNAGPKDEDQDYIVDHSIAIYLLNPDGLFTDYYGRSRSAEQISDSVRRHMAAFRSVLS

SEQ ID NO: 62734 - protein, 266 aa, Homo sapiens; identical to SEQ ID NO: 62733

SEQ ID NO: 62735 - protein, 136 aa, Homo sapiens
MLLLTRSPTAWHRLSQLKPRVLPGTLGGQALHLRSWLLSRQGPAETGGQGQPQGPGLRTRLLITGLFGAGLGGAWLALRAEKERLQQQKRTEALRQAAVGQGDFHLLDHRGRARCKADFRGQWVLMYFGFTHCPDI

SEQ ID NO: 62736 - protein, 136 aa, Homo sapiens; identical to SEQ ID NO: 62735

SEQ ID NO: 62737 - protein, 266 aa, Homo sapiens; identical to SEQ ID NO: 62733

SEQ ID NO: 62738 - protein, 266 aa, Homo sapiens; identical to SEQ ID NO: 62733

SEQ ID NO: 62739 - protein, 348 aa, Homo sapiens
MPRSFLVKKVKLDAFSSADLESAYGRARSDLGAPLHDKGYLSDYVGPSSVYDGDAEAALLKGPSPEPMYAAAVRGELGPAAAGSAPPPTPRPELATAAGGYINGDAAVSEGYAADAFFITDGRSRRKASNAGSAAAPSTASAAAPDGDAGGGGGAGGRSLGSGPGGRGGTRAGAGTEARAGPGAAGAGGRHACGECGKTYATSSNLSRHKQTHRSLDSQLARRCPTCGKVYVSMPAMAMHLLTHDLRHKCGVCGKAFSRPWLLQGHMRSHTGEKPFGCAHCGKAFADRSNLRAHMQTHSAFKHFQCKRCKKSFALKSYLNKHYESACFKGGAGGPAAPAPPQLSPVQA

SEQ ID NO: 62740 - protein, 1630 aa, Homo sapiens
MLKCIPLWRCNRHVESVDKRHCSLQAVPEEIYRYSRSLEELLLDANQLRELPKPFFRLLNLRKLGLSDNEIQRLPPEVANFMQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPPSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSASTVSEAEPEGPSAEAQGGSQQEATTAGGEEDAEEDYQEPTVHFAEDALLPGDDREIEEGQPEAPWTLPGGRQRLIRKDTPHYKKHFKISKLPQPEAVVALLQGMQPDGEGPVAPGGWHNGPHAPWAPRAQKEEEEEEEGSPQEEEVEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLSPDFAEELRSLEPSPSPGPQEEDGEVALVLLGRPSPGAVGPEDVALCSSRRPVRPGRRGLGPVPS

SEQ ID NO: 62741 - protein, 1549 aa, Homo sapiens
MQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPPSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSASTVSEAEPEGPSAEAQGGSQQEATTAGGEEDAEEDYQEPTVHFAEDALLPGDDREIEEGQPEAPWTLPGGRQRLIRKDTPHYKKHFKISKLPQPEAVVALLQGMQPDGEGPVAPGGWHNGPHAPWAPRAQKEEEEEEEGSPQEEEVEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLSPDFAEELRSLEPSPSPGPQEEDGEVALVLLGRPSPGAVGPEDVALCSSRRPVRPGRRGLGPVPS

SEQ ID NO: 62742 - protein, 755 aa, Homo sapiens
MQPDGEGPVAPGGWHNGPHAPWAPRAQKEEEEEEEGSPQEEEVEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPLRPGRRGLGPVPS

SEQ ID NO: 62743 - protein, 1655 aa, Homo sapiens
MLKCIPLWRCNRHVESVDKRHCSLQAVPEEIYRYSRSLEELLLDANQLRELPKPFFRLLNLRKLGLSDNEIQRLPPEVANFMQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPPSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSASTVSEAEPEGPSAEAQGGSQQEATTAGGEEDAEEDYQEPTVHFAEDALLPGDDREIEEGQPEAPWTLPGGRQRLIRKDTPHYKKHFKISKLPQPEAVVALLQGMQPDGEGPVAPGGWHNGPHAPWAPRAQKEEEEEEEGSPQEEEVEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLPLSGKKFDYRAFAALPSSRPVYDIQSPDFAEELRSLEPSPSPGPQEEDGEVALVLLGRPSPGAVGPEDVALCSSRRPVRPGRRGLGPVPS

SEQ ID NO: 62744 - protein, 808 aa, Homo sapiens
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 62745 - protein, 781 aa, Homo sapiens
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQDRSRLSWPGRSARSGGGRWRPNAPRGRWPRAP

SEQ ID NO: 62746 - protein, 707 aa, Homo sapiens
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGHWETQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 62747 - protein, 356 aa, Homo sapiens
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQPKDPRLKEFLPQPPPLFLPPLQPQATGRRRRRTRTQQRTAALLTDGTTKTGAAWSRRPSLCWPSRTTGAPGAK

SEQ ID NO: 62748 - protein, 791 aa, Homo sapiens
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 62749 - protein, 780 aa, Homo sapiens
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEEAESVLAQQDDWSTGGQVSRASQVSNSDHKSSKSPESDWSSWEAEGSWEQGWQEPSSQEPPPDGTRLASEYNWGGPESSDKGDPFATLSARPSTQDRSRLSWPGRSARSGGGRWRPNAPRGRWPRAP

SEQ ID NO: 62750 - protein, 707 aa, Homo sapiens; identical to SEQ ID NO: 62746

SEQ ID NO: 62751 - protein, 787 aa, Homo sapiens
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQSPTGAAGKLRAPGNRAGRSQAPRSHLLTVHGWPASITGVAQSPATRATPSLPCLHVPAPSRGQTLGVRTTGRASRLTVDRSRLSWPGRSARSGGGRWRPNAPRGRWPRAP

SEQ ID NO: 62752 - protein, 220 aa, Homo sapiens
MIKPKWGGLVWAQWHGPLARPSGTLPFASSMPSPVDASSADGGSGLGSHRRKRTTFSKGQLLELERAFAAWPYPNISTHEHLAWVTCLPEAKVQVWFQKRWAKIIKNRKSGILSPGSECPQSSCSLPDTLQQPWDPQMPGQPPPSSGTPQRTSVCRHSSCPAPGLSPRQGWEGAKAVAPWGSAGASEVHPSLERATPQTSLGSLSDLIYALAIVVNVDHS

SEQ ID NO: 62753 - protein, 216 aa, Homo sapiens
MGGSGVGTAWHGPLARPSGTLPFASSMPSPVDASSADGGSGLGSHRRKRTTFSKGQLLELERAFAAWPYPNISTHEHLAWVTCLPEAKVQVWFQKRWAKIIKNRKSGILSPGSECPQSSCSLPDTLQQPWDPQMPGQPPPSSGTPQRTSVCRHSSCPAPGLSPRQGWEGAKAVAPWGSAGASEVHPSLERATPQTSLGSLSDLIYALAIVVNVDHS

SEQ ID NO: 62754 - protein, 215 aa, Homo sapiens
MMTTGWTGLCLPPVNPSRVSSSSLETSTTESIFAHDGGSGLGSHRRKRTTFSKGQLLELERAFAAWPYPNISTHEHLAWVTCLPEAKVQVWFQKRWAKIIKNRKSGILSPGSECPQSSCSLPDTLQQPWDPQMPGQPPPSSGTPQRTSVCRHSSCPAPGLSPRQGWEGAKAVAPWGSAGASEVHPSLERATPQTSLGSLSDLIYALAIVVNVDHS

SEQ ID NO: 62755 - protein, 215 aa, Homo sapiens; identical to SEQ ID NO: 62754

SEQ ID NO: 62756 - protein, 403 aa, Homo sapiens
MSGRVGDLSPRQKEALAKFRENVQDVLPALPNPDDYFLLRWLRARSFDLQKSEAMLRKHVEFRKQKDIDNIISWQPPEVIQQYLSGGMCGYDLDGCPVWYDIIGPLDAKGLLFSASKQDLLRTKMRECELLLQECAHQTTKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGIYVLRFDNTYSFIHAKKVNFTVEVLLPDKASEEKMKQLGAGTPK

SEQ ID NO: 62757 - protein, 320 aa, Homo sapiens
MSGRVGDLSPRQKEALAKFRENVQDVLPALPNPDDYFLLRWLRARSFDLQKSEAMLRKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGIYVLRFDNTYSFIHAKKVNFTVEVLLPDKASEEKMKQLGAGTPK

SEQ ID NO: 62758 - protein, 329 aa, Homo sapiens
MLRKVIQQYLSGGMCGYDLDGCPVWYDIIGPLDAKGLLFSASKQDLLRTKMRECELLLQECAHQTTKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGIYVLRFDNTYSFIHAKKVNFTVEVLLPDKASEEKMKQLGAGTPK

SEQ ID NO: 62759 - protein, 392 aa, Homo sapiens
MSGRVGDLSPRQKEALAKFRENVQDVLPALPNPDDYFLLRWLRARSFDLQKSEAMLRKHVEFRKQKDIDNIISWQPPEVIQQYLSGGMCGYDLDGCPVWYDIIGPLDAKGLLFSASKQDLLRTKMRECELLLQECAHQTTKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGICKYLCLGNALKPHVQLSACEVPLPPWIFGSEC

SEQ ID NO: 62760 - protein, 400 aa, Homo sapiens
MSGRVGDLSPKQAETLAKFRENVQDVLPALPNPDDYFLLRWLRARNFDLQKSEALLRKYMEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVLRFDNTYSFVHAKKVSFTVEVLLPDEGMQKYDKELTPV

SEQ ID NO: 62761 - protein, 353 aa, Homo sapiens
MEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVESESGKSCCHLPVIICSHELQNSHSNSQVMAYQMVRKCKLSRPLPLPASN

SEQ ID NO: 62762 - protein, 341 aa, Homo sapiens
MEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVLRFDNTYSFVHAKKVSFTVEVLLPDEGMQKYDKELTPV

SEQ ID NO: 62763 - protein, 323 aa, Homo sapiens
MVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVLRFDNTYSFVHAKKVSFTVEVLLPDEGMQKYDKELTPV

SEQ ID NO: 62764 - protein, 323 aa, Homo sapiens; identical to SEQ ID NO: 62763

SEQ ID NO: 62765 - protein, 406 aa, Homo sapiens
MSSRVGDLSPQQQEALARFRENLQDLLPILPNADDYFLLRWLRARNFDLQKSEDMLRRHMEFRKQQDLDNIVTWQPPEVIQLYDSGGLCGYDYEGCPVYFNIIGSLDPKGLLLSASKQDMIRKRIKVCELLLHECELQTQKLGRKIEMALMVFDMEGLSLKHLWKPAVEVYQQFFSILEANYPETLKNLIVIRAPKLFPVAFNLVKSFMSEETRRKIVILGDNWKQELTKFISPDQLPVEFGGTMTDPDGNPKCLTKINYGGEVPKSYYLCEQVRLQYEHTRSVGRGSSLQVENEILFPGCVLRWQFASDGGDIGFGVFLKTKMGEQQSAREMTEVLPSQRYNAHMVPEDGSLTCLQAGVYVLRFDNTYSRMHAKKLSYTVEVLLPDKASEETLQSLKAMRPSPTQ

SEQ ID NO: 62766 - protein, 360 aa, Homo sapiens
MSSRVGDLSPQQQEALARFRENLQDLLPILPNADDYFLLRWLRARNFDLQKSEDMLRRHMEFRKQQDLDNIVTWQPPEVIQLYDSGGLCGYDYEGCPVYFNIIGSLDPKGLLLSASKQDMIRKRIKVCELLLHECELQTQKLGRKIEMALMVFDMEGLSLKHLWKPAVEVYQQFFSILEANYPETLKNLIVIRAPKLFPVAFNLVKSFMSEETRRKIVILGDNWKQELTKFISPDQLPVEFGGTMTDPDGNPKCLTKINYGGEVPKSYYLCEQVRLQYEHTRSVGRGSSLQVENEILFPGCVLRWQFASDGGDIGFGVFLKTKMGEQQSAREMTEVLPSQRYNAHMVPEDGSLTCLQAGV

SEQ ID NO: 62767 - protein, 360 aa, Homo sapiens
MLRRHMEFRKQQDLDNIVTWQPPEVIQLYDSGGLCGYDYEGCPVYFNIIGSLDPKGLLLSASKQDMIRKRIKVCELLLHECELQTQKLGRKIEMALMVFDMEGLSLKHLWKPAVEVYQQFFSILEANYPETLKNLIVIRAPKLFPVAFNLVKSFMSEETRRKIVILGDNWKQELTKFISPDQLPVEFGGTMTDPDGNPKCLTKINYGGEVPKSYYLCEQVRLQYEHTRSVGRGSSLQVENEILFPGCVLRWQFASDGGDIGFGVFLKTKMGEQQSAREMTEVLPSQRYNAHMVPEDGSLTCLQAGVYVRGLCSLITSPSLQMSCASTTPTAGCMPRSSATLWRCCFPTRPLRRRCRVSRR

SEQ ID NO: 62768 - protein, 391 aa, Homo sapiens
MLMTTSSCAGCELETLTCRNPKTCSEGPKSPQPTSCPHALRAWHMEFRKQQDLDNIVTWQPPEVIQLYDSGGLCGYDYEGCPVYFNIIGSLDPKGLLLSASKQDMIRKRIKVCELLLHECELQTQKLGRKIEMALMVFDMEGLSLKHLWKPAVEVYQQFFSILEANYPETLKNLIVIRAPKLFPVAFNLVKSFMSEETRRKIVILGDNWKQELTKFISPDQLPVEFGGTMTDPDGNPKCLTKINYGGEVPKSYYLCEQVRLQYEHTRSVGRGSSLQVENEILFPGCVLRWQFASDGGDIGFGVFLKTKMGEQQSAREMTEVLPSQRYNAHMVPEDGSLTCLQAGVYVLRFDNTYSRMHAKKLSYTVEVLLPDKASEETLQSLKAMRPSPTQ

SEQ ID NO: 62769 - protein, 751 aa, Homo sapiens
PAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 62770 - protein, 2159 aa, Homo sapiens
MPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGEAPGDLPAAGGPPSGAMPFYNPAQLAQACATSGSSRLGRIGQRKHLVLN

SEQ ID NO: 62771 - protein, 2357 aa, Homo sapiens
MQPPPQTVPSGMAGPPPAGNPRSVFWASSPYRRRANNNAAVAPTTCPLQPVTDPFAFSRQALQSTPLGSSSKSSPPVLQGPAPAGFSQHPGLLVPHTHARDSSQGPCEPLPGPLTQPRAHASPFSGALTPSAPPGPEMNRSAEVGPSSEPEVQTLPYLPHYIPGVDPETSHGGHPHGNMPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 62772 - protein, 385 aa, Homo sapiens
MDLLPTSILLASLWICSHLHPPGVSVDLPPTSILLVSLWICSHLHPPGVSVDRPPPPSSWCLCGSPPTSILLVSLWICSPPPSSWCLCGSAPTSILLVSLWIWRLWGLTEGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPVSSVRPQGRSGRNDGLLALSSPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 62773 - protein, 2134 aa, Homo sapiens
MPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKAPGDLPAAGGPPSGAMPFYNPAQLAQACATSGSSRLGRIGQRKHLVLN

SEQ ID NO: 62774 - protein, 140 aa, Homo sapiens
MDLLPTSILLASLWICSHLHPPGVSVDLPPTSILLVSLWICSHLHPPGVSVDRPPPPSSWCLCGSPPTSILLVSLWICSPPPSSWCLCGSAPTSILLVSLWIWRLWGLTEVGHVEFVFLPWLISWNIMFSKLFSCFLYLG

SEQ ID NO: 62775 - protein, 734 aa, Homo sapiens
MFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYRPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPVRPQGRSGRNDGLLALSSPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 62776 - protein, 1727 aa, Homo sapiens
MFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGEAPGDLPAAGGPPSGAMPFYNPAQLAQACATSGSSRLGRIGQRKHLVLN

SEQ ID NO: 62777 - protein, 2154 aa, Homo sapiens
MPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKLSRCSSMSSLSREVSQHFNQAPGDLPAAGGPPSGAMPFYNPAQLAQACATSGSSRLGRIGQRKHLVLN

SEQ ID NO: 62778 - protein, 506 aa, Homo sapiens
  MOD_RES (1)..(1): Any amino acid
XSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPVRPQGRSGRNDGLLALSSPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 62779 - protein, 1059 aa, Homo sapiens
ARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGEAPGDLPAAGGPPSGAMPFYNPAQLAQACATSGSSRLGRIGQRKHLVLN

SEQ ID NO: 62780 - protein, 200 aa, Homo sapiens
MPKTVQAAPPALPGPPGAPVNMYSRRAAGTRARYVDVLNPSGTQRSEPALAPADFVAPLAPLPIPSNLFVPTPVSSVRPQGRSGRNDGLLALSSPDAEEPQLPDGTGREGPAAARGLANPEPAPEPKVLSSAASLPGSELPSSRPEGSQGGEAPGDLPAAGGPPSGAMPFYNPAQLAQACATSGSSRLGRIGQRKHLVLN

SEQ ID NO: 62781 - protein, 307 aa, Homo sapiens
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSAHQRLEPATLSGIVGFILSLLCGALNLIRGFHAIESLLQSDGDDFNYIIAFFLGTAACLYQCYLLVYYTGWRNVKSFLTFGLICLCNMYLYELRNLWQLFFHVTVGAFVTLQIWLRQAQGKAPDYDV

SEQ ID NO: 62782 - protein, 109 aa, Homo sapiens
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRP

SEQ ID NO: 62783 - protein, 289 aa, Homo sapiens
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSAHQRLEPATLSGIVGFILSLLCGALNLIRGFHAIESLLQSDGDDFNYIIAFFLGTAACLYQCYLLVYYTGWRNVKSFLTFGLICLCNMYLYELRNLWQLFFHVTVGAFV

SEQ ID NO: 62784 - protein, 138 aa, Homo sapiens
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINL

SEQ ID NO: 62785 - protein, 218 aa, Homo sapiens
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSAHQRLEPATLSGIVGFILSLLCGALNLIRGFHAIESLL

SEQ ID NO: 62786 - protein, 101 aa, Homo sapiens
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMM

SEQ ID NO: 62787 - protein, 307 aa, Homo sapiens; identical to SEQ ID NO: 62781

SEQ ID NO: 62788 - protein, 765 aa, Homo sapiens
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCMEDEDLQALKESMQMSLSLLPPTALVGLITFGRMVQVHELGCEGISKSYVFRGTKDLSAKQLQEMLGLSKVPLTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQARFLLSKVNPSQTHNNMYAWGQESGAPILTDDVSLQVFMDHLKKLAVSSAA

SEQ ID NO: 62789 - protein, 663 aa, Homo sapiens
MPLIFLYVVDTCMEDEDLQALKESMQMSLSLLPPTALVGLITFGRMVQVHELGCEGISKSYVFRGTKDLSAKQLQEMLGLSKVPLTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQRRDFPKTSGEILENQEKARSACLKFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQARFLLSKVNPSQTHNNMYAWGQESGAPILTDDVSLQVFMDHLKKLAVSSAA

SEQ ID NO: 62790 - protein, 563 aa, Homo sapiens
MLGLSKVPLTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQARFLLSKVNPSQTHNNMYAWGQESGAPILTDDVSLQVFMDHLKKLAVSSAA

SEQ ID NO: 62791 - protein, 736 aa, Homo sapiens
MTTYLEFIQQNEERDGVRFSWNVWPSSRLEATRMVVPVAALFTPLKERPDLPPIQYEPVLCSRTTCRAVLNPLCQVDYRAKLWACNFCYQRNQRGPQMPLIFLYVVDTCMEDEDLQALKESMQMSLSLLPPTALVGLITFGRMVQVHELGCEGISKSYVFRGTKDLSAKQLQEMLGLSKVPLTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQARFLLSKVNPSQTHNNMYAWGQESGAPILTDDVSLQVFMDHLKKLAVSSAA

SEQ ID NO: 62792 - protein, 169 aa, Homo sapiens
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCMEDEDLQALKESMQMSLSLLPPTALVGLITF

SEQ ID NO: 62793 - protein, 94 aa, Homo sapiens
MTTYLEFIQQNEERDGVRFSWNVWPSSRLEATRMVVPVAALFTPLKERPDLPPIQYEPVLCSRTTCRAVLNPLCQVDYRAKLWACNFCYQRNQV

SEQ ID NO: 62794 - protein, 140 aa, Homo sapiens
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCME

SEQ ID NO: 62795 - protein, 40 aa, Homo sapiens
MTTYLEFIQQNEERDGVRFSWNVWPSSRLEATRMVVPVAA

SEQ ID NO: 62796 - protein, 767 aa, Homo sapiens
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRFLQPVHKIDMNLTDLLGELQRDPWPVTQGKRPLRSTGVALSIAVGLLEGTFPNTGARIMLFTGGPPTQGPGMVVGDELKIPIRSWHDIEKDNARFMKKATKHYEMLANRTAANGHCIDIYACALDQTGLLEMKCCANLTGGYMVMGDSFNTSLFKQTFQRIFTKDFNGDFRMAFGATLDVKTSRELKIAGAIGPCVSLNVKGPCVSENELGVGGTSQWKICGLDPTSTLGIYFEVVNQHNTPIPQGGRGAIQFVTHYQHSSTQRRIRVTTIARNWADVQSQLRHIEAAFDQEAAAVLMARLGVFRAESEEGPDVLRWLDRQLIRLCQKFGQYNKEDPTSFRLSDSFSLYPQFMFHLRRSPFLQVFNNSPDESSYYRHHFARQDLTQSLIMIQPILYSYSFHGPPEPVLLDSSSILADRILLMDTFFQIVIYLGETIAQWRKAGYQDMPEYENFKHLLQAPLDDAQEILQARFPMPRYINTEHGGSQARFLLSKVNPSQTHNNLYAWGQETGAPILTDDVSLQVFMDHLKKLAVSSAC

SEQ ID NO: 62797 - protein, 767 aa, Homo sapiens; identical to SEQ ID NO: 62796

SEQ ID NO: 62798 - protein, 767 aa, Homo sapiens; identical to SEQ ID NO: 62796

SEQ ID NO: 62799 - protein, 767 aa, Homo sapiens; identical to SEQ ID NO: 62796

SEQ ID NO: 62800 - protein, 246 aa, Homo sapiens
QRRIRVTTIARNWADVQSQLRHIEAAFDQEAAAVLMARLGVFRAESEEGPDVLRWLDRQLIRLCQKFGQYNKEDPTSFRLSDSFSLYPQFMFHLRRSPFLQVFNNSPDESSYYRHHFARQDLTQSLIMIQPILYSYSFHGPPETIAQWRKAGYQDMPEYENFKHLLQAPLDDAQEILQARFPMPRYINTEHGGSQARFLLSKVNPSQTHNNLYAWGQETGAPILTDDVSLQVFMDHLKKLAVSSAC

SEQ ID NO: 62801 - protein, 331 aa, Homo sapiens
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRFLQPVHKIDMNLTDLLGELQRDPWPVTQGKRPLRSTGVALSIAVGLLEGTFPNTGARIMLFTGGPPTQGPGMVVGDELKIPIRSWHDIEKDNARFMKKATK

SEQ ID NO: 62802 - protein, 399 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 62803 - protein, 399 aa, Homo sapiens; identical to SEQ ID NO: 62802

SEQ ID NO: 62804 - protein, 123 aa, Homo sapiens
MAERRRHKKRIQEVGEPSKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 62805 - protein, 760 aa, Homo sapiens
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 62806 - protein, 417 aa, Homo sapiens
MFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKKKKETFKKKTYTCAITTVKATETKAGKWSRWE

SEQ ID NO: 62807 - protein, 378 aa, Homo sapiens
EHEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 62808 - protein, 781 aa, Homo sapiens
MVRVLRSMCLPQLCSHILSVCSGTTSDRNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 62809 - protein, 854 aa, Homo sapiens
MASEGPREPESEGIKLSADVKPFVPRFAGLNVAWLESSEACVFPSSAATYYPFVQEPPVTEQKIYTEDMAFGASTFPPQYLSSEITLHPYAYSPYTLDSTQNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 62810 - protein, 860 aa, Homo sapiens
PASRRPAAGLRDAASSAPRGMASEGPREPESEGIKLSADVKPFVPRFAGLNVAWLESSEACVFPSSAATYYPFVQEPPVTEQKIYTEDMAFGASTFPPQYLSSEITLHPYAYSPYTLDSTQNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVLMPLPILLHVQETLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 62811 - protein, 275 aa, Homo sapiens
GTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVS

SEQ ID NO: 62812 - protein, 60 aa, Homo sapiens
MPLPILLHVQEQILKMLVYHLLKLYLRILPTTKKNTLFILPKSLKHHKVVTLNKMKPQER

SEQ ID NO: 62813 - protein, 786 aa, Homo sapiens
MAFGASTFPPQYLSSEITLHPYAYSPYTLDSTQNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 62814 - protein, 248 aa, Homo sapiens
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAEPQSAPDTGFWPVPAVVTAVFILLVALVMFAWYRCRCSQQRREKKFFLLEPQMKVAALRAGAQQGLSRASAELWTPDSEPTPRPLALVFKPSPLGALELLSPQPLFPYAADP

SEQ ID NO: 62815 - protein, 295 aa, Homo sapiens
MLQGPGSLLLLFLASHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELVITSVKRWQKGQREFKRISRSIRKLQC

SEQ ID NO: 62816 - protein, 103 aa, Homo sapiens
MASRWAVQLLLVAAWSMGCGEALKCYTCKEPMTSASCRTITRCKPEDTACMTTLVTVEAEYPFNQSPVVTRSCSSSCVATDPDSIGAAHLIFCCFRDLCNSEL

SEQ ID NO: 62817 - protein, 211 aa, Homo sapiens
MISRMEKMTMMMKILIMFALGMNYWSCSGFPVYDYDPSSLRDALSASVVKVNSQSLSPYLFRAFRSSLKRVEVLDENNLVMNLEFSIRETTCRKDSGEDPATCAFQRDYYVSTAVCRSTVKVSAQQVQGVHARCSWSSSTSESYSSEEMIFGDMLGSHKWRNNYLFGLISDESISEQFYDRSLGIMRRVLPPGNRRYPNHRHRARINTDFE

SEQ ID NO: 62818 - protein, 211 aa, Homo sapiens; identical to SEQ ID NO: 62817

SEQ ID NO: 62819 - protein, 121 aa, Homo sapiens
MAPRPLLLLLLLLGGSAARPAPPRARRHSDGTFTSELSRLREGARLQRLLQGLVGKRSEQDAENSMAWTRLSAGLLCPSGSNMPILQAWMPLDGTWSPWLPPGPMVSEPAGAAAEGTLRPR

SEQ ID NO: 62820 - protein, 440 aa, Homo sapiens
MRPHLSPPLQQLLLPVLLACAAHSTGALPRLCDVLQVLWEEQDQCLQELSREQTGDLGTEQPVPGCEGMWDNISCWPSSVPGRMVEVECPRFLRMLTSRNGSLFRNCTQDGWSETFPRPNLACGVNVNDSSNEKRHSYLLKLKVMYTVGYSSSLVMLLVALGILCAFRRLHCTRNYIHMHLFVSFILRALSNFIKDAVLFSSDDVTYCDAHRAGCKLVMVLFQYCIMANYSWLLVEGLYLHTLLAISFFSERKYLQGFVAFGWGSPAIFVALWAIARHFLEDVGCWDINANASIWWIIRGPVILSILINFILFINILRILMRKLRTQETRGNEVSHYKRLARSTLLLIPLFGIHYIVFAFSPEDAMEIQLFFELALGSFQGLVVAVLYCFLNGEVQLEVQKKWQQWHLREFPLHPVASFSNSTKASHLEQSQGTCRTSII

SEQ ID NO: 62821 - protein, 95 aa, Homo sapiens
MKLLMVLMLAALLLHCYADSGCKLLEDMVEKTINSDISIPEYKELLQEFIDSDAAAEAMGKFKQCFLNQSHRTLKNFGLMMHTVYDSIWCNMKSN

SEQ ID NO: 62822 - protein, 93 aa, Homo sapiens
MKLLMVLMLAALSQHCYAGSGCPLLENVISKTINPQVSKTEYKELLQEFIDDNATTNAIDELKECFLNQTDETLSNVEVFMQLIYDSSLCDLF

SEQ ID NO: 62823 - protein, 120 aa, Homo sapiens
MKLLMVLMLAALSQHCYAGSGCPLLENVISKTINPQVSKTEYKELLQEFIDDNATTNAIDELKECFLNQTDETLSNVEVFMVISFSSYKLFKSPDQGQVGSSFLTDNAKATSEQAFSYIG

SEQ ID NO: 62824 - protein, 104 aa, Homo sapiens
MKLAALLGLCVALSCSSAAAFLVGSAKPVAQPVAALESAAEAGAGTLANPLGTLNPLKLLLSSLGIPVNHLIEGSQKCVAELGPQAVGAVKALKALLGALTVFG

SEQ ID NO: 62825 - protein, 93 aa, Homo sapiens
MKLVTIFLLVTISLCSYSATAFLINKVPLPVDKLAPLPLDNILPFMDPLKLLLKTLGISVEHLVEGLRKCVNELGPEASEAVKKLLEALSHLV

SEQ ID NO: 62826 - protein, 617 aa, Homo sapiens
MAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEPQSAPKENKPYALNSEKNFPMDMSDDYETQQWPERKLKHMQFPPMYEENSRDNPFKRTNEIVEEQYTPQSLATLESVFQELGKLTGPNNQKRERMDEEQKLYTDDEDDIYKANNIAYEDVVGGEDWNPVEEKIESQTQEEVRDSKENIEKNEQINDEMKRSGQLGIQEEDLRKESKDQLSDDVSKVIAYLKRLVNAAGSGRLQNGQNGERATRLFEKPLDSQSIYQLIEISRNLQIPPEDLIEMLKTGEKPNGSVEPERELDLPVDLDDISEADLDHPDLFQNRMLSKSGYPKTPGRAGTEALPDGLSVEDILNLLGMESAANQKTSYFPNPYNQEKVLPRLPYGAGRSRSNQLPKAAWIPHVENRQMAYENLNDKDQELGEYLARMLVKYPEIINSNQVKRVPGQGSSEDDLQEEEQIEQAIKEHLNQGSSQETDKLAPVSKRFPVGPPKNDDTPNRQYWDEDLLMKVLEYLNQEKAEKGREHIAKRAMENM

SEQ ID NO: 62827 - protein, 144 aa, Homo sapiens
MAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEPQSAPKENKPYALNSEKNFP

SEQ ID NO: 62828 - protein, 125 aa, Homo sapiens
MAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEP

SEQ ID NO: 62829 - protein, 477 aa, Homo sapiens
MAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLRGEDWNPVEEKIESQTQEEVRDSKENIEKNEQINDEMKRSGQLGIQEEDLRKESKDQLSDDVSKVIAYLKRLVNAAGSGRLQNGQNGERATRLFEKPLDSQSIYQLIEISRNLQIPPEDLIEMLKTGEKPNGSVEPERELDLPVDLDDISEADLDHPDLFQNRMLSKSGYPKTPGRAGTEALPDGLSVEDILNLLGMESAANQKTSYFPNPYNQEKVLPRLPYGAGRSRSNQLPKAAWIPHVENRQMAYENLNDKDQELGEYLARMLVKYPEIINSNQVKRVPGQGSSEDDLQEEEQIEQAIKEHLNQGSSQETDKLAPVSKRFPVGPPKNDDTPNRQYWDEDLLMKVLEYLNQEKAEKGREHIAKRAMENM

SEQ ID NO: 62830 - protein, 468 aa, Homo sapiens
MGFLGTGTWILVLVLPIQAFPKPGGSQDKSLHNRELSAERPLNEQIAEAEEDKIKKTYPPENKPGQSNYSFVDNLNLLKAITEKEKIEKERQSIRSSPLDNKLNVEDVDSTKNRKLIDDYDSTKSGLDHKFQDDPDGLHQLDGTPLTAEDIVHKIAARIYEENDRAVFDKIVSKLLNLGLITESQAHTLEDEVAEVLQKLISKEANNYEEDPNKPTSWTENQAGKIPEKVTPMAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 62831 - protein, 236 aa, Homo sapiens
MAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 62832 - protein, 57 aa, Homo sapiens
MAAIQDGLAKGENDETVSNTLTLTNGLERRTKTYSEDNFEELQYFPNFYALLKSIDS

SEQ ID NO: 62833 - protein, 329 aa, Homo sapiens
MSAFDTNPFADPVDVNPFQDPSVTQLTNAPQGGLAEFNPFSETNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 62834 - protein, 287 aa, Homo sapiens
MSAFDTNPFADTNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVSGVGRADSKWEEAGNRFLPLPRDVFHHCSWAS

SEQ ID NO: 62835 - protein, 347 aa, Homo sapiens
MAQSRDGGNPFAEPSELDNPFQDPAVIQHRPSRQYATLDVYNPFETREPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMCSTLALLLNFLACLASFCVETNNGAGFGLSILWVLLFTPCSFVCWYRPMYKAFRSDSSFNFFVFFFIFFVQDVLFVLQAIGIPGWGFSGWISALVVPKGNTAVSVLMLLVALLFTGIAVLGIVMLKRIHSLYRRTGASFQKAQQEFAAGVFSNPAVRTAAANAAAGAAENAFRAP

SEQ ID NO: 62836 - protein, 321 aa, Homo sapiens
MAQSRDGGNPFAEPSELDNPFQPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMCSTLALLLNFLACLASFCVETNNGAGFGLSILWVLLFTPCSFVCWYRPMYKAFRSDSSFNFFVFFFIFFVQDVLFVLQAIGIPGWGFSGWISALVVPKGNTAVSVLMLLVALLFTGIAVLGIVMLKRIHSLYRRTGASFQKAQQEFAAGVFSNPAVRTAAANAAAGAAENAFRAP

SEQ ID NO: 62837 - protein, 229 aa, Homo sapiens
MSEKENNFPPLPKFIPVKPCFYQNFSDEIPVEHQVLVKRIYRLWMFYCATLGVNLIACLAWWIGGGSGTNFGLAFVWLLLFTPCGYVCWFRPVYKAFRADSSFNFMAFFFIFGAQFVLTVIQAIGFSGWGACGWLSAIGFFQYSPGAAVVMLLPAIMFSVSAAMMAIAIMKVHRIYRGAGGSFQKAQTEWNTGTWRNPPSREAQYNNFSGNSLPEYPTVPSYPGSGQWP

SEQ ID NO: 62838 - protein, 195 aa, Homo sapiens
MSEKENNFPPLPKFIPVKPCFYQNFSDEIPVEHQVLVKRIYRLWMFYCATLGVNLIACLAWWIGGGSGTNFGLAFVWLLLFTPCGYVCWFRPVYKAFRGWLSAIGFFQYSPGAAVVMLLPAIMFSVSAAMMAIAIMKVHRIYRGAGGSFQKAQTEWNTGTWRNPPSREAQYNNFSGNSLPEYPTVPSYPGSGQWP

SEQ ID NO: 62839 - protein, 195 aa, Homo sapiens
MIQRHIPVCGRSRPYQRGCVVQAGSSGSPGWSHFKIICGLAPAPSEAVLSARNNCEHTGGCRLQPALVGETEMSEKENNFPPLPKFIPVKPCFYQNFSDEIPVEHQVLVKRIYRLWMFYCATLGVNLIACLAWWIGGGSGTNFGLAFVWLLLFTPCGYVCWFRPVYKAFRADSSFNFMAFFFIFGAQFVLTVIQA

SEQ ID NO: 62840 - protein, 235 aa, Homo sapiens
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 62841 - protein, 235 aa, Homo sapiens; identical to SEQ ID NO: 62840

SEQ ID NO: 62842 - protein, 164 aa, Homo sapiens
MFLPRLRGRYSSPACQHDQAPLLPLDVTDSSFSFMAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 62843 - protein, 360 aa, Homo sapiens
MFVARSIAADHKDLIHDVSFDFHGRRMATCSSDQSVKVWDKSESGDWHCTASWKTHSGSVWRVTWAHPEFGQVLASCSFDRTAAVWEEIVGESNDKLRGQSHWVKRTTLVDSRTSVTDVKFAPKHMGLMLATCSADGIVRIYEAPDVMNLSQWSLQHEISCKLSCSCISWNPSSSRAHSPMIAVGSDDSSPNAMAKVQIFEYNENTRKYAKAETLMTVTDPVHDIAFAPNLGRSFHILAIATKDVRIFTLKPVRKELTSSGGPTKFEIHIVAQFDNHNSQVWRVSWNITGTVLASSGDDGCVRLWKANYMDNWKCTGILKGNGSPVNGSSQQGTSNPSLGSTIPSLQNSLNGSSAGRKHS

SEQ ID NO: 62844 - protein, 421 aa, Homo sapiens
MFVARSIAADHKDLIHDVSFDFHGRRMATCSSDQSVKVWDKSESGDWHCTASWKTHSGSVWRVTWAHPEFGQVLASCSFDRTAAVWEEIVGESNDKLRGQSHWVKRTTLVDSRTSVTDVKFAPKHMGLMLATCSADGIVRIYEAPDVMNLSQWSLQHEISCKLSCSCISWNPSSSRAHSPMIAVGSDDSSPNAMAKVQIFEYNENTRKYAKAETLMTVTDPVHDIAFAPNLGRSFHILAIATKDVRIFTLKPVRKELTSSGGPTKFEIHIVAQFDNHNSQVWRVSWNITGTVLASSGDDGCVRLWKANYMDNWKCTGILKGNGSPVNGSSQQGTSNPSLGSTIPSLQNSLNGSSAGRYFFTPLDSPRAGSRWSSYAQLLPPPPPPLVEHSCDADTANLQYPHPRRRYLSRPLNPLPENEGI

SEQ ID NO: 62845 - protein, 1024 aa, Homo sapiens
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKVNQDSFEHALEVAEAAAETSLEGGNMALAIFIPVLIISLLLGGAYIYITRCRYYSNLRLPLMYSHPYSQITVETEFDNPIYETGETREYEVSI

SEQ ID NO: 62846 - protein, 948 aa, Homo sapiens
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVLAEAAAETSLEGGNMALAIFIPVLIISLLLGGAYIYITRCRYYSNLRLPLMYSHPYSQITVETEFDNPIYETGETREYEVSI

SEQ ID NO: 62847 - protein, 949 aa, Homo sapiens
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKTEESLACDNPGLPENGYQILYKRLYLPGESLTFMCYEGFELMGEVTIRCILGQPSHWNGPLPVCKVAEAAAETSLEGGNMALAIFIPVLIISLLLGGAYIYITRCRYYSNLRLPLMYSHPYSQITVETEFDNPIYETGETREYEVSI

SEQ ID NO: 62848 - protein, 139 aa, Homo sapiens
MYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKDVATIPTSACL

SEQ ID NO: 62849 - protein, 1013 aa, Homo sapiens
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKVAEAAAETSLEGGNMALAIFIPVLIISLLLGGAYIYITRCRYYSNLRLPLMYSHPYSQITVETEFDNPIYETGETREYEVSI

SEQ ID NO: 62850 - protein, 1023 aa, Homo sapiens
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKVNQDSFEHALEAEAAAETSLEGGNMALAIFIPVLIISLLLGGAYIYITRCRYYSNLRLPLMYSHPYSQITVETEFDNPIYETGETREYEVSI

SEQ ID NO: 62851 - protein, 85 aa, Homo sapiens
GFGTDVDYETAFIHYRLASEQQHSAQAMFNLGYMHEKGLGIKQDIHLAKRFYDMAASQPRCTSSSLPSPLQIGRRLFLAVHTGNK

SEQ ID NO: 62852 - protein, 794 aa, Homo sapiens
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDGDYNAAVIQYLLLAEQGYEVAQSNAAFILDQREASIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIRETNIRDMFTQLDMDQLLGPEWDLYLMTIIALLLGTVIAYRQRQHQDMPAPRPPGPRPAPPQQEGPPEQQPPQ

SEQ ID NO: 62853 - protein, 301 aa, Homo sapiens
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLVSRL

SEQ ID NO: 62854 - protein, 688 aa, Homo sapiens
MKPLSLLIEILIILGVTIKTIKAEEHNKRQKERNVTTQVSVNEIKQYLSHILEQRTSSNVINKRENLLEKKKNQRKIRIKGIQNKDILKRNKNHLQKQAEKNFTDEGDQLFKMGIKVLQQSKSQKQKEEAYLLFAKAADMGNLKAMEKMADALLFGNFGVQNITAAIQLYESLAKEGSCKAQNALGFLSSYGIGMEYDQAKALIYYTFGSAGGNMMSQMILGYRYLSGINVLQNCEVALSYYKKVADYIADTFEKSEGVPVEKVRLTERPENLSSNSEILDWDIYQYYKFLAERGDVQIQVSLGQLHLIGRKGLDQDYYKALHYFLKAAKAGSANAMAFIGKMYLEGNAAVPQNNATAFKYFSMAASKGNAIGLHGLGLLYFHGKGVPLNYAEALKYFQKAAEKGWPDAQFQLGFMYYSGSGIWKDYKLAFKYFYLASQSGQPLAIYYLAKMYATGTGVVRSCRTAVELYKGVCELGHWAEKFLTAYFAYKDGDIDSSLVQYALLAEMGYEVAQSNSAFILESKKANILEKEKMYPMALLLWNRAAIQGNAFARVKIGDYHYYGYGTKKDYQTAATHYSIAANKYHNAQAMFNLAYMYEHGLGITKDIHLARRLYDMAAQTSPDAHIPVLFAVMKLETTHLLRDILFFNFTTRWNWLKLDNTIGPHWDLFVIGLIVPGLILLLRNHHG

SEQ ID NO: 62855 - protein, 575 aa, Homo sapiens
MKPLSLLIEILIILGVTIKTIKAEEHNKRQKERNVTTQVSVNEIKQYLSHILEQRTSSNVINKRENLLEKKKNQRKIRIKGIQNKDILKRNKNHLQKQAEKNFTDEGDQLFKMGIKVLQQSKSQKQKEEAYLLFAKAADMGNLKAMEKMADALLFGNFGVQNITAAIQLYESLAKEGSCKAQNALGFLSSYGIGMEYDQAKALIYYTFGSAGGNMMSQMILGYRYLSGINVLQNCEVALSYYKKVADYIADTFEKSEGVPVEKVRLTERPENLSSNSEILDWDIYQYYKFLAERGDVQIQVSLGQLHLIGRKGLDQDYYKALHYFLKAAKAGSANAMAFIGKMYLEGNAAVPQNNATAFKYFSMAASKGNAIGLHGLGLLYFHGKGVPLNYAEALKYFQKAAEKGWPDAQFQLGFMYYSGSGIWKDYKLAFKYFYLASQSGQPLAIYYLAKMYATGTGVVRSCRTAVEKRLTFLKKRRCIQWRFSYGIELPFKDIHLARRLYDMAAQTSPDAHIPVLFAVMKLETTHLLRDILFFNFTTRWNWLKLDNTIGPHWDLFVIGLIVPGLILLLRNHHG

SEQ ID NO: 62856 - protein, 610 aa, Homo sapiens
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAFQCTALSNPERGYMNCLPSASGSFRYGSSCEFSCEQGFVLKGSKRLQCGPTGEWDNEKPTCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 62857 - protein, 484 aa, Homo sapiens
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 62858 - protein, 485 aa, Homo sapiens
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQMVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 62859 - protein, 547 aa, Homo sapiens
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 62860 - protein, 547 aa, Homo sapiens
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAFQCTALSNPERGYMNCLPSASGSFRYGSSCEFSCEQGFVLKGSKRLQCGPTGEWDNEKPTCEVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 62861 - protein, 484 aa, Homo sapiens; identical to SEQ ID NO: 62857

SEQ ID NO: 62862 - protein, 485 aa, Homo sapiens; identical to SEQ ID NO: 62858

SEQ ID NO: 62863 - protein, 547 aa, Homo sapiens; identical to SEQ ID NO: 62859

SEQ ID NO: 62864 - protein, 547 aa, Homo sapiens; identical to SEQ ID NO: 62860

SEQ ID NO: 62865 - protein, 385 aa, Homo sapiens
MGCRRTREGPSKAMIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYNPLFIPVAVMVTAFSGLAFIIWLARRLKKGKKSKRSMNDPY

SEQ ID NO: 62866 - protein, 830 aa, Homo sapiens
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 62867 - protein, 768 aa, Homo sapiens
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 62868 - protein, 768 aa, Homo sapiens
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 62869 - protein, 646 aa, Homo sapiens
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQGKSIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 62870 - protein, 830 aa, Homo sapiens; identical to SEQ ID NO: 62866

SEQ ID NO: 62871 - protein, 644 aa, Homo sapiens
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 62872 - protein, 646 aa, Homo sapiens; identical to SEQ ID NO: 62869

SEQ ID NO: 62873 - protein, 768 aa, Homo sapiens; identical to SEQ ID NO: 62868

SEQ ID NO: 62874 - protein, 768 aa, Homo sapiens; identical to SEQ ID NO: 62867

SEQ ID NO: 62875 - protein, 644 aa, Homo sapiens; identical to SEQ ID NO: 62871

SEQ ID NO: 62876 - protein, 829 aa, Homo sapiens
ANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 62877 - protein, 646 aa, Homo sapiens
  MOD_RES (1)..(1): Any amino acid
XANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQGKSIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 62878 - protein, 753 aa, Homo sapiens
VVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 62879 - protein, 790 aa, Homo sapiens
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQDDGKCPLNPHSHLGTYGVFTNAAFDPSP

SEQ ID NO: 62880 - protein, 428 aa, Homo sapiens
MAVGASGLEGDKMAGAMPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 62881 - protein, 402 aa, Homo sapiens
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 62882 - protein, 412 aa, Homo sapiens
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 62883 - protein, 472 aa, Homo sapiens
MATKCGNCGPGYSTPLEAMKGPREEIVYLPCIYRNTGTEAPDYLATVDVDPKSPQYCQVIHRLPMPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAHELRYPGGDCSSDIWI

SEQ ID NO: 62884 - protein, 408 aa, Homo sapiens
MPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAHELRYPGGDCSSDIWI

SEQ ID NO: 62885 - protein, 410 aa, Homo sapiens
MATKCGNCGPGYSTPLEAMKGPREEIVYLPCIYRNTGTEAPDYLATVDVDPKSPQYCQVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAHELRYPGGDCSSDIWI

SEQ ID NO: 62886 - protein, 453 aa, Homo sapiens
MPGSSGAGMEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQAEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGHVVLAQCRVLMASVGAACHSDHGDQPSPVLLSYGVPFDVARNALRLSVGRSTTRAEVDLVVQDLKQAVAQLEDQA

SEQ ID NO: 62887 - protein, 235 aa, Homo sapiens
FSNPFCGETFPRKPDLKGTHRWAPQPSEGGQAPFHYFLGGTRLHPAAPGAPGGRTSGSLLNVKMMKMKTFMMICFHLINTVTFVPVSKVSGQAEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKVSPGELEEMS

SEQ ID NO: 62888 - protein, 317 aa, Homo sapiens
MEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQAEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKVSPGELEEMS

SEQ ID NO: 62889 - protein, 351 aa, Homo sapiens
MEAAVAPGRDAPAPAASQPSGCGKHNSPERKVYMDYNATTPLEPEVIQAMTKAMWEAWGNPSSPYSAAVTFVPVSKVSGQAEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGHVVLAQCRVLMASVGAACHSDHGDQPSPVLLSYGVPFDVARNALRLSVGRSTTRAEVDLVVQDLKQAVAQLEDQA

SEQ ID NO: 62890 - protein, 239 aa, Homo sapiens
MEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTEAAELVTQNCEAYEAHMRDVRDYLEERLEAEFGQKRIHLNSQFPGTQRLPNTCNFSIRGPRLQGHVVLAQCRVLMASVGAACHSDHGDQPSPVLLSYGVPFDVARNALRLSVGRSTTRAEVDLVVQDLKQAVAQLEDQA

SEQ ID NO: 62891 - protein, 445 aa, Homo sapiens
MEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQAEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGHVVLAQCRVLMASVGAACHSDHGDQPSPVLLSYGVPFDVARNALRLSVGRSTTRAEVDLVVQDLKQAVAQLEDQA

SEQ ID NO: 62892 - protein, 321 aa, Homo sapiens
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLTKPLGTQVAVAVHQWLDIPEKWNKIKLVVTQEDVELAYQEAMMNMARLNRTGGLLICLPREQAARFCAEIKSPKYGEGHQAWIIGIVEKGNRTARIIDKPRIIEVAPQVATQNVNPTPGATS

SEQ ID NO: 62893 - protein, 392 aa, Homo sapiens
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLTKPLGTQVAVAVHQWLDIPEKWNKIKLVVTQEDVELAYQEAMMNMARLNRTAAGLMHTFNAHAATDITGFGILGHAQNLAKQQRNEVSFVIHNLPVLAKMAAVSKACGNMFGLMHGTCPETSGGLLICLPREQAARFCAEIKSPKYGEGHQAWIIGIVEKGNRTARIIDKPRIIEVAPQVATQNVNPTPGATS

SEQ ID NO: 62894 - protein, 321 aa, Homo sapiens; identical to SEQ ID NO: 62892

SEQ ID NO: 62895 - protein, 166 aa, Homo sapiens
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVL

SEQ ID NO: 62896 - protein, 92 aa, Homo sapiens
MDTCVIPLRHGGLSLVQTTDYIYPIVDDPYMMGRIACANVLSDLYAMGVTECDNMLMLLGVSNKMTDRERDKVMPLIIQGFKDAAEEAGTSV

SEQ ID NO: 62897 - protein, 325 aa, Homo sapiens
MDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLTKPLGTQVAVAVHQWLDIPEKWNKIKLVVTQEDVELAYQEAMMNMARLNRTAAGLMHTFNAHAATDITGFGILGHAQNLAKQQRNEVSFVIHNLPVLAKMAAVSKACGNMFGLMHGTCPETSGGLLICLPREQAARFCAEIKSPKYGEGHQAWIIGIVEKGNRTARIIDKPRIIEVAPQVATQNVNPTPGATS

SEQ ID NO: 62898 - protein, 324 aa, Homo sapiens
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLTKPLGTQVAVAVHQWLDIPEKWNKIKLVVTQEDVELAYQEAMMNMARLNRTAAGLMHTFNAHAATDITGFGILGHAQNLAKQQRNEVSFVIHNLPVLAKMAAVSKACGNMFGLMHGTCPETSDVQ

SEQ ID NO: 62899 - protein, 399 aa, Homo sapiens
MAEASATGACGEAMAAAEGSSGPAGLTLGRLTGFSGMKGLVGGQEEASQEAGLPAGAGPSPTFPALGIGMDSCVIPLRHGGLSLVQTTDFFYPLVEDPYMMGRIACANVLSDLYAMGITECDNMLMLLSVSQSMSEEEREKVTPLMVKGFRDAAEEGGTAVTGGQTVVNPWIIIGGVATVVCQPNEFIMPDSAVVGDVLVLTKPLGTQVAVNAHQWLDNPERWNKVKMVVSREEVELAYQEAMFNMATLNRTAAGLMHTFNAHAATDITGFGILGHSQNLAKQQRNEVSFVIHNLPIIAKMAAVSKASGRFGLLQGTSAETSGGLLICLPREQAARFCSEIKSSKYGEGHQAWIVGIVEKGNRTARIIDKPRVIEVLPRGATAAVLAPDSSNASSEPSS

SEQ ID NO: 62900 - protein, 483 aa, Homo sapiens
  MOD_RES (60)..(60): Selenocysteine
  MOD_RES (449)..(449): Selenocysteine
MAEASATGACGEAMAAAEGSSGPAGLTLGRSFSNYRPFEPQALGLSPSWRLTGFSGMKGCGCKVPQEALLKLLAGLTRPDVRPPLGRGLVGGQEEASQEAGLPAGAGPSPTFPALGIGMDSCVIPLRHGGLSLVQTTDFFYPLVEDPYMMGRIACANVLSDLYAMGITECDNMLMLLSVSQSMSEEEREKVTPLMVKGFRDAAEEGGTAVTGGQTVVNPWIIIGGVATVVCQPNEFIMPDSAVVGDVLVLTKPLGTQVAVNAHQWLDNPERWNKVKMVVSREEVELAYQEAMFNMATLNRTAAGLMHTFNAHAATDITGFGILGHSQNLAKQQRNEVSFVIHNLPIIAKMAAVSKASGRFGLLQGTSAETSGGLLICLPREQAARFCSEIKSSKYGEGHQAWIVGIVEKGNRTARIIDKPRVIEVLPRGATAAVLAPDSSNASSEPSSCDERTEVVWTLEPLSTITDGSQELIVRNFQRRLPA

SEQ ID NO: 62901 - protein, 448 aa, Homo sapiens
  MOD_RES (60)..(60): Selenocysteine
MAEASATGACGEAMAAAEGSSGPAGLTLGRSFSNYRPFEPQALGLSPSWRLTGFSGMKGCGCKVPQEALLKLLAGLTRPDVRPPLGRGLVGGQEEASQEAGLPAGAGPSPTFPALGIGMDSCVIPLRHGGLSLVQTTDFFYPLVEDPYMMGRIACANVLSDLYAMGITECDNMLMLLSVSQSMSEEEREKVTPLMVKGFRDAAEEGGTAVTGGQTVVNPWIIIGGVATVVCQPNEFIMPDSAVVGDVLVLTKPLGTQVAVNAHQWLDNPERWNKVKMVVSREEVELAYQEAMFNMATLNRTAAGLMHTFNAHAATDITGFGILGHSQNLAKQQRNEVSFVIHNLPIIAKMAAVSKASGRFGLLQGTSAETSGGLLICLPREQAARFCSEIKSSKYGEGHQAWIVGIVEKGNRTARIIDKPRVIEVLPRGATAAVLAPDSSNASSEPSS

SEQ ID NO: 62902 - protein, 391 aa, Homo sapiens
MAEASATGACGEAMAAAEGSSGPAGLTLGRSFSNYRPFEPQEAGLPAGAGPSPTFPALGIGMDSCVIPLRHGGLSLVQTTDFFYPLVEDPYMMGRIACANVLSDLYAMGITECDNMLMLLSVSQSMSEEEREKVTPLMVKGFRDAAEEGGTAVTGGQTVVNPWIIIGGVATVVCQPNEFIMPDSAVVGDVLVLTKPLGTQVAVNAHQWLDNPERWNKVKMVVSREEVELAYQEAMFNMATLNRTAAGLMHTFNAHAATDITGFGILGHSQNLAKQQRNEVSFVIHNLPIIAKMAAVSKASGRFGLLQGTSAETSGGLLICLPREQAARFCSEIKSSKYGEGHQAWIVGIVEKGNRTARIIDKPRVIEVLPRGATAAVLAPDSSNASSEPSS

SEQ ID NO: 62903 - protein, 556 aa, Homo sapiens
MGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSTPAASCEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSCHCSGRTLRETVLESSPILTLLNESFISTWSLVKELEELQNNQENSSHQKLAGLHLEKYSFPVEMMICLPNGTVVHHINANYFLDITSVKPEEIESNLFSFSSTFEDPSTATYMQFLKEGLRRGLPLLQP

SEQ ID NO: 62904 - protein, 590 aa, Homo sapiens
  MOD_RES (127)..(127): Selenocysteine
  MOD_RES (462)..(462): Selenocysteine
MGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSCSVTQTGVQWCSHSSLQPQLPWLNCSSCLSLLRSTPAASCEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSCCGSGRTLRETVLESSPILTLLNESFISTWSLVKELEELQNNQENSSHQKLAGLHLEKYSFPVEMMICLPNGTVVHHINANYFLDITSVKPEEIESNLFSFSSTFEDPSTATYMQFLKEGLRRGLPLLQP

SEQ ID NO: 62905 - protein, 556 aa, Homo sapiens
  MOD_RES (428)..(428): Selenocysteine
MGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSTPAASCEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSCCGSGRTLRETVLESSPILTLLNESFISTWSLVKELEELQNNQENSSHQKLAGLHLEKYSFPVEMMICLPNGTVVHHINANYFLDITSVKPEEIESNLFSFSSTFEDPSTATYMQFLKEGLRRGLPLLQP

SEQ ID NO: 62906 - protein, 381 aa, Homo sapiens
  MOD_RES (59)..(59): Selenocysteine
  MOD_RES (300)..(300): Selenocysteine
  MOD_RES (318)..(318): Selenocysteine
  MOD_RES (330)..(330): Selenocysteine
  MOD_RES (345)..(345): Selenocysteine
  MOD_RES (352)..(352): Selenocysteine
  MOD_RES (367)..(367): Selenocysteine
  MOD_RES (369)..(369): Selenocysteine
  MOD_RES (376)..(376): Selenocysteine
  MOD_RES (378)..(378): Selenocysteine
MWRSLGLALALCLLPSGGTESQDQSSLCKQPPAWSIRDQDPMLNSNGSVTVVALLQASCYLCILQASKLEDLRVKLKKEGYSNISYIVVNHQGISSRLKYTHLKNKVSEHIPVYQQEENQTDVWTLLNGSKDDFLIYDRCGRLVYHLGLPFSFLTFPYVEEAIKIAYCEKKCGNCSLTTLKDEDFCKRVSLATVDKTVETPSPHYHHEHHHNHGHQHLGSSELSENQQPGAPNAPTHPAPPGLHHHHKHKGQHRQGHPENRDMPASEDLQDLQKKLCRKRCINQLLCKLPTDSELAPRSCCCHCRHLIFEKTGSAITCQCKENLPSLCSCQGLRAEENITESCQCRLPPAACQISQQLIPTEASASCRCKNQAKKCECPSN

SEQ ID NO: 62907 - protein, 209 aa, Homo sapiens
  MOD_RES (59)..(59): Selenocysteine
MWRSLGLALALCLLPSGGTESQDQSSLCKQPPAWSIRDQDPMLNSNGSVTVVALLQASCYLCILQASKLEDLRVKLKKEGYSNISYIVVNHQGISSRLKYTHLKNKVSEHIPVYQQEENQTDVWTLLNGSKDDFLIYDRCGRLVYHLGLPFSFLTFPYVEEAIKIAYCEKKCGNCSLTTLKDEDFCKRVSLATVDKTVETPSPHYHHEH

SEQ ID NO: 62908 - protein, 381 aa, Homo sapiens; identical to SEQ ID NO: 62906
  MOD_RES (59)..(59): Selenocysteine
  MOD_RES (300)..(300): Selenocysteine
  MOD_RES (318)..(318): Selenocysteine
  MOD_RES (330)..(330): Selenocysteine
  MOD_RES (345)..(345): Selenocysteine
  MOD_RES (352)..(352): Selenocysteine
  MOD_RES (367)..(367): Selenocysteine
  MOD_RES (369)..(369): Selenocysteine
  MOD_RES (376)..(376): Selenocysteine
  MOD_RES (378)..(378): Selenocysteine

SEQ ID NO: 62909 - protein, 310 aa, Homo sapiens
  MOD_RES (59)..(59): Selenocysteine
  MOD_RES (300)..(300): Selenocysteine
MWRSLGLALALCLLPSGGTESQDQSSLCKQPPAWSIRDQDPMLNSNGSVTVVALLQASCYLCILQASKLEDLRVKLKKEGYSNISYIVVNHQGISSRLKYTHLKNKVSEHIPVYQQEENQTDVWTLLNGSKDDFLIYDRCGRLVYHLGLPFSFLTFPYVEEAIKIAYCEKKCGNCSLTTLKDEDFCKRVSLATVDKTVETPSPHYHHEHHHNHGHQHLGSSELSENQQPGAPNAPTHPAPPGLHHHHKHKGQHRQGHPENRDMPASEDLQDLQKKLCRKRCINQLLCKLPTDSELAPRSCCCHCRHLIFE

SEQ ID NO: 62910 - protein, 381 aa, Homo sapiens; identical to SEQ ID NO: 62906
  MOD_RES (59)..(59): Selenocysteine
  MOD_RES (300)..(300): Selenocysteine
  MOD_RES (318)..(318): Selenocysteine
  MOD_RES (330)..(330): Selenocysteine
  MOD_RES (345)..(345): Selenocysteine
  MOD_RES (352)..(352): Selenocysteine
  MOD_RES (367)..(367): Selenocysteine
  MOD_RES (369)..(369): Selenocysteine
  MOD_RES (376)..(376): Selenocysteine
  MOD_RES (378)..(378): Selenocysteine

SEQ ID NO: 62911 - protein, 87 aa, Homo sapiens
  MOD_RES (13)..(13): Selenocysteine
MALAVRVVYCGACGYKSKYLQLKKKLEDEFPGRLDICGEGTPQATGFFEVMVAGKLIHSKKKGDGYVDTESKFLKLVAAIKAALAQG

SEQ ID NO: 62912 - protein, 88 aa, Homo sapiens [sequence omitted]

SEQ ID NO: 62913 - protein, 116 aa, Homo sapiens
  MOD_RES (95)..(95): Selenocysteine
MSFCSFFGGEVFQNHFEPGVYVCAKCGYELFSSRSKYAHSSPWPAFTETIHADSVAKRPEHNRSEALKVSCGKCGNGLGHEFLNDGPKPGQSRFCIFSSSLKFVPKGKETSASQGH

SEQ ID NO: 62914 - protein, 226 aa, Homo sapiens
MSFCSFFGGEVFQNHFEPGVYVCAKCGYELFSSRSKYAHSSPWPAFTETIHADSVAKRPEHNRSEALKVRGHRGGGGTGAARESREPVPPSSLCLPHSSRGLEASIPGLLPLPGSCHPRLSGEPGLLVQMWETGQVSCTGSRTKVNLLCRRSAWEIGVWEETPSASPSKGLHCGCIMARSSPSCLVIFPGVLWQVWQWVGPRVPERRPQAGAVPILNIQQLAEVCP

SEQ ID NO: 62915 - protein, 775 aa, Homo sapiens
MASAGHIITLLLWGYLLELWTGGHTADTTHPRLRLSHKELLNLNRTSIFHSPFGFLDLHTMLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKTDDRVVKMDLGLLFLRLHKSDAGTYFCQTVEHSFVHTVRKITLEVVEEEKVEDMFNKDDEEDRHHRMPCPAQSSISQGAKPWYKEFLQLIGYSNFQRVEEYCEKVWCTDRKRKKLKMSPSKWKYANPQEKKLRSKPEHYRLPRHTLDS

SEQ ID NO: 62916 - protein, 715 aa, Homo sapiens
MLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKTDDRVVKMDLGLLFLRLHKSDAGTYFCQTVEHSFVHTVRKITLEVVEEEKVEDMFNKDDEEDRHHRMPCPAQSSISQGAKPWYKEFLQLIGYSNFQRVEEYCEKVWCTDRKRKKLKMSPSKWKYANPQEKKLRSKPEHYRLPRHTLDS

SEQ ID NO: 62917 - protein, 766 aa, Homo sapiens
MASAGHIITLLLWGYLLELWTGGHTADTTHPRLRLSHKELLNLNRTSIFHSPFGFLDLHTMLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKTDDRVVKMDLGLLFLRLHKSDAGTYFCQTVEHSFVHTVRKITLEVVEEEKVEDMFNKDDEEDRHHRMPCPAQSSISQGAKPWYKEFLQLIGYSNFQRVEEYCEKVWCTDRKRKKLKMSPSKWKYANPQHYRLPRHTLDS

SEQ ID NO: 62918 - protein, 761 aa, Homo sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 62919 - protein, 761 aa, Homo sapiens; identical to SEQ ID NO: 62918

SEQ ID NO: 62920 - protein, 723 aa, Homo sapiens
MPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 62921 - protein, 629 aa, Homo sapiens
MIPWPASDRKKSECAFKKKSNEELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 62922 - protein, 761 aa, Homo sapiens; identical to SEQ ID NO: 62918

SEQ ID NO: 62923 - protein, 629 aa, Homo sapiens; identical to SEQ ID NO: 62921

SEQ ID NO: 62924 - protein, 220 aa, Homo sapiens
MIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPH

SEQ ID NO: 62925 - protein, 321 aa, Homo sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIY

SEQ ID NO: 62926 - protein, 236 aa, Homo sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNEELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVC

SEQ ID NO: 62927 - protein, 723 aa, Homo sapiens; identical to SEQ ID NO: 62920

SEQ ID NO: 62928 - protein, 1074 aa, Homo sapiens
MKGTCVIAWLFSSLGLWRLAHPEAQGTTQCQRTEHPVISYKEIGPWLREFRAKNAVDFSQLTFDPGQKELVVGARNYLFRLQLEDLSLIQAVEWECDEATKKACYSKGKSKEECQNYIRVLLVGGDRLFTCGTNAFTPVCTNRSLSNLTEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVCKNDIGGRFLLEDTWTTFMKARLNCSRPGEVPFYYNELQSTFFLPELDLIYGIFTTNVNSIAASAVCVFNLSAIAQAFSGPFKYQENSRSAWLPYPNPNPHFQCGTVDQGLYVNLTERNLQDAQKFILMHEVVQPVTTVPSFMEDNSRFSHVAVDVVQGREALVHIIYLATDYGTIKKVRVPLNQTSSSCLLEEIELFPERRREPIRSLQILHSQSVLFVGLREHVVKIPLKRCQFYRTRSTCIGAQDPYCGWDVVMKKCTSLEESLSMTQWEQSISACPTRNLTVDGHFGVWSPWTPCTHTDGSAVGSCLCRTRSCDSPAPQCGGWQCEGPGMEIANCSRNGGWTPWTSWSPCSTTCGIGFQVRQRSCSNPTPRHGGRVCVGQNREERYCNEHLLCPPHMFWTGWGPWERCTAQCGGGIQARRRICENGPDCAGCNVEYQSCNTNPCPELKKTTPWTPWTPVNISDNGGHYEQRFRYTCKARLADPNLLEVGRQRIEMRYCSSDGTSGCSTDGLSGDFLRAGRYSAHTVNGAWSAWTSWSQCSRDCSRGIRNRKRVCNNPEPKYGGMPCLGPSLEYQECNILPCPVDGVWSCWSPWTKCSATCGGGHYMRTRSCSNPAPAYGGDICLGLHTEEALCNTQPCPESWSEWSDWSECEASGVQVRARQCILLFPMGSQCSGNTTESRPCVFDSNFIPEVSVARSSSVEEKRCGEFNMFHMIAVGLSSSILGCLLTLLVYTYCQRYQQQSHDATVIHPVSPAPLNTSITNHINKLDKYDSVEAIKAFNKNNLILEERNKYFNPHLTGKTYSNAYFTDLNNYDEY

SEQ ID NO: 62929 - protein, 254 aa, Homo sapiens
MKGTCVIAWLFSSLGLWRLAHPEAQGTTQCQRTEHPVISYKEIGPWLREFRAKNAVDFSQLTFDPGQKELVVGARNYLFRLQLEDLSLIQAVEWECDEATKKACYSKGKSKEECQNYIRVLLVGGDRLFTCGTNAFTPVCTNRSLSNLTEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVC

SEQ ID NO: 62930 - protein, 666 aa, Homo sapiens
MTPPPPGRAAPSAPRARVPGPPARLGLPLRLRLLLLLWAAAASAQGHLRSGPRIFAVWKGHVGQDRVDFGQTEPHTVLFHEPGSSSVWVGGRGKVYLFDFPEGKNASVRTVNIGSTKGSCLDKRDCENYITLLERRSEGLLACGTNARHPSCWNLVNGTVVPLGEMRGYAPFSPDENSLVLFEGDEVYSTIRKQEYNGKIPRFRRIRGESELYTSDTVMQNPQFIKATIVHQDQAYDDKIYYFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 62931 - protein, 501 aa, Homo sapiens
MRGYAPFSPDENSLVLFEGDEVYSTIRKQEYNGKIPRFRRIRGESELYTSDTVMQNPQFIKATIVHQDQAYDDKIYYFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 62932 - protein, 652 aa, Homo sapiens
MTPPPPGRAAPSAPRARVPGPPARLGLPLRLRLLLLLWAAAASAQGHLRSGPRIFAVWKGHVGQDRVDFGQTEPHTVLFHEPGSSSVWVGGRGKVYLFDFPEGKNASVRTDCENYITLLERRSEGLLACGTNARHPSCWNLVNGTVVPLGEMRGYAPFSPDENSLVLFEGDEVYSTIRKQEYNGKIPRFRRIRGESELYTSDTVMQNPQFIKATIVHQDQAYDDKIYYFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 62933 - protein, 402 aa, Homo sapiens
MKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQTKNLNQDQQHGRKANKISYQSSSTEERRLHYGENGVQKDVSQRSIYSQTEKLVAGKSQIQAPNPKQEPWHGENAKGESGQSTNREQDLLSHEQKGRHQHGSHGGLDIVIIEQEDDSDRHLAQHLNNDRNPLFT

SEQ ID NO: 62934 - protein, 462 aa, Homo sapiens
MKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQTKNLNQDQQHGRKANKISYQSSSTEERRLHYGENGVQKDVSQSSIYSQTEEKAQGKSQKQITIPSQEQEHSQKANKISYQSSSTEERRLHYGENGVQKDVSQRSIYSQTEKLVAGKSQIQAPNPKQEPWHGENAKGESGQSTNREQDLLSHEQKGRHQHGSHGGLDIVIIEQEDDSDRHLAQHLNNDRNPLFT

SEQ ID NO: 62935 - protein, 582 aa, Homo sapiens
MKSIILFVLSLLLILEKQAAVMGQKGGSKGQLPSGSSQFPHGQKGQHYFGQKDQQHTKSKGSFSIQHTYHVDINDHDWTRKSQQYDLNALHKATKSKQHLGGSQQLLNYKQEGRDHDKSKGHFHMIVIHHKGGQAHHGTQNPSQDQGNSPSGKGLSSQCSNTEKRLWVHGLSKEQASASGAQKGRTQGGSQSSYVLQTEELVVNKQQRETKNSHQNKGHYQNVVDVREEHSSKLQTSLHPAHQDRLQHGPKDIFTTQDELLVYNKNQHQTKNLSQDQEHGRKAHKISYPSSRTEERQLHHGEKSVQKDVSKGSISIQTEEKIHGKSQNQVTIHSQDQEHGHKENKISYQSSSTEERHLNCGEKGIQKGVSKGSISIQTEEQIHGKSQNQVRIPSQAQEYGHKENKISYQSSSTEERRLNSGEKDVQKGVSKGSISIQTEEKIHGKSQNQVTIPSQDQEHGHKENKMSYQSSSTEERRLNYGGKSTQKDVSQSSISFQIEKLVEGKSQIQTPNPNQDQWSGQNAKGKSGQSADSKQDLLSHEQKGRYKQESSESHNIVITEHEVAQDDHLTQQYNEDRNPIST

SEQ ID NO: 62936 - protein, 2677 aa, Homo sapiens
MSTCCWCTPGGASTIDFLKRYASNTPSGEFQTADEDLCYCLECVAEYHKARDELPFLHEVLWELETLRLINHFEKSMKAEIGDDDELYIVDNNGEMPLFDITGQDFENKLRVPLLEILKYPYLLLHERVNELCVEALCRMEQANCSFQVFDKHPGIYLFLVHPNEMVRRWAILTARNLGKVDRDDYYDLQEVLLCLFKVIELGLLESPDIYTSSVLEKGKLILLPSHMYDTTNYKSYWLGICMLLTILEEQAMDSLLLGSDKQNDFMQSILHTMEREADDDSVDPFWPALHCFMVILDRLGSKVWGQLMDPIVAFQTIINNASYNREIRHIRNSSVRTKLEPESYLDDMVTCSQIVYNYNPEKTKKDSGWRTAICPDYCPNMYEEMETLASVLQSDIGQDMRVHNSTFLWFIPFVQSLMDLKDLGVAYIAQVVNHLYSEVKEVLNQTDAVCDKVTEFFLLILVSVIELHRNKKCLHLLWVSSQQWVEAVVKCAKLPTTAFTRSSEKSSGNCSKGTAMISSLSLHSMPSNSVQLAYVQLIRSLLKEGYQLGQQSLCKRFWDKLNLFLRGNLSLGWQLTSQETHELQSCLKQIIRNIKFKAPPCNTFVDLTSACKISPASYNKEESEQMGKTSRKDMHCLEASSPTFSKEPMKVQDSVLIKADNTIEGDNNEQNYIKDVKLEDHLLAGSCLKQSSKNIFTERAEDQIKISTRKQKSVKEISSYTPKDCTSRNGPERGCDRGIIVSTRLLTDSSTDALEKVSTSNEDFSLKDDALAKTSKRKTKVQKDEICAKLSHVIKKQHRKSTLVDNTINLDENLTVSNIESFYSRKDTGVQKGDGFIHNLSLDPSGVLDDKNGEQKSQNNVLPKEKQLKNEELVIFSFHENNCKIQEFHVDGKELIPFTEMTNASEKKSSPFKDLMTVPESRDEEMSNSTSVIYSNLTREQAPDISPKSDTLTDSQIDRDLHKLSLLAQASVITFPSDSPQNSSQLQRKVKEDKRCFTANQNNVGDTSRGQVIIISDSDDDDDERILSLEKLTKQDKICLEREHPEQHVSTVNSKEEKNPVKEEKTETLFQFEESDSQCFEFESSSEVFSVWQDHPDDNNSVQDGEKKCLAPIANTTNGQGCTDYVSEVVKKGAEGIEEHTRPRSISVEEFCEIEVKKPKRKRSEKPMAEDPVRPSSSVRNEGQSDTNKRDLVGNDFKSIDRRTSTPNSRIQRATTVSQKKSSKLCTCTEPIRKVPVSKTPKKTHSDAKKGQNRSSNYLSCRTTPAIVPPKKFRQCPEPTSTAEKLGLKKGPRKAYELSQRSLDYVAQLRDHGKTVGVVDTRKKTKLISPQNLSVRNNKKLLTSQELQMQRQIRPKSQKNRRRLSDCESTDVKRAGSHTAQNSDIFVPESDRSDYNCTGGTEVLANSNRKQLIKCMPSEPETIKAKHGSPATDDACPLNQCDSVVLNGTVPTNEVIVSTSEDPLGGGDPTARHIEMAALKEGEPDSSSDAEEDNLFLTQNDPEDMDLCSQMENDNYKLIELIHGKDTVEVEEDSVSRPQLESLSGTKCKYKDCLETTKNQGEYCPKHSEVKAADEDVFRKPGLPPPASKPLRPTTKIFSSKSTSRIAGLSKSLETSSALSPSLKNKSKGIQSILKVPQPVPLIAQKPVGEMKNSCNVLHPQSPNNSNRQGCKVPFGESKYFPSSSPVNILLSSQSVSDTFVKEVLKWKYEMFLNFGQCGPPASLCQSISRPVPVRFHNYGDYFNVFFPLMVLNTFETVAQEWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSYINVQEIKLVMEIIKLIKDKRKDVSFRNIGIITHYKAQKTMIQKDLDKEFDRKGPAEVDTVDAFQGRQKDCVIVTCVRANSIQGSIGFLASLQRLNVTITRAKYSLFILGHLRTLMENQHWNQLIQDAQKRGAIIKTCDKNYRHDAVKILKLKPVLQRSLTHPPTIAPEGSRPQGGLPSSKLDSGFAKTSVAASLYHTPSDSKEITLTVTSKDPERPPVHDQLQDPRLLKRMGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 62937 - protein, 2706 aa, Homo sapiens
MSTCCWCTPGGASTIDFLKRYASNTPSGEFQTADEDLCYCLECVAEYHKARDELPFLHEVLWELETLRLINHFEKSMKAEIGDDDELYIVDNNGEMPLFDITGQDFENKLRVPLLEILKYPYLLLHERVNELCVEALCRMEQANCSFQVFDKHPGIYLFLVHPNEMVRRWAILTARNLGKVDRDDYYDLQEVLLCLFKVIELGLLESPDIYTSSVLEKGKLILLPSHMYDTTNYKSYWLGICMLLTILEEQAMDSLLLGSDKQNDFMQSILHTMEREADDDSVDPFWPALHCFMVILDRLGSKVWGQLMDPIVAFQTIINNASYNREIRHIRNSSVRTKLEPESYLDDMVTCSQIVYNYNPEKTKKDSGWRTAICPDYCPNMYEEMETLASVLQSDIGQDMRVHNSTFLWFIPFVQSLMDLKDLGVAYIAQVVNHLYSEVKEVLNQTDAVCDKVTEFFLLILVSVIELHRNKKCLHLLWVSSQQWVEAVVKCAKLPTTAFTRSSEKSSGNCSKGTAMISSLSLHSMPSNSVQLAYVQLIRSLLKEGYQLGQQSLCKRFWDKLNLFLRGNLSLGWQLTSQETHELQSCLKQIIRNIKFKAPPCNTFVDLTSACKISPASYNKEESEQMGKTSRKDMHCLEASSPTFSKEPMKVQDSVLIKADNTIEGDNNEQNYIKDVKLEDHLLAGSCLKQSSKNIFTERAEDQIKISTRKQKSVKEISSYTPKDCTSRNGPERGCDRGIIVSTRLLTDSSTDALEKVSTSNEDFSLKDDALAKTSKRKTKVQKDEICAKLSHVIKKQHRKSTLVDNTINLDENLTVSNIESFYSRKDTGVQKGDGFIHNLSLDPSGVLDDKNGEQKSQNNVLPKEKQLKNEELVIFSFHENNCKIQEFHVDGKELIPFTEMTNASEKKSSPFKDLMTVPESRDEEMSNSTSVIYSNLTREQAPDISPKSDTLTDSQIDRDLHKLSLLAQASVITFPSDSPQNSSQLQRKVKEDKRCFTANQNNVGDTSRGQVIIISDSDDDDDERILSLEKLTKQDKICLEREHPEQHVSTVNSKEEKNPVKEEKTETLFQFEESDSQCFEFESSSEVFSVWQDHPDDNNSVQDGEKKCLAPIANTTNGQGCTDYVSEVVKKGAEGIEEHTRPRSISVEEFCEIEVKKPKRKRSEKPMAEDPVRPSSSVRNEGQSDTNKRDLVGNDFKSIDRRTSTPNSRIQRATTVSQKKSSKLCTCTEPIRKVPVSKTPKKTHSDAKKGQNRSSNYLSCRTTPAIVPPKKFRQCPEPTSTAEKLGLKKGPRKAYELSQRSLDYVAQLRDHGKTVGVVDTRKKTKLISPQNLSVRNNKKLLTSQELQMQRQIRPKSQKNRRRLSDCESTDVKRAGSHTAQNSDIFVPESDRSDYNCTGGTEVLANSNRKQLIKCMPSEPETIKAKHGSPATDDACPLNQCDSVVLNGTVPTNEVIVSTSEDPLGGGDPTARHIEMAALKEGEPDSSSDAEEDNLFLTQNDPEDMDLCSQMENDNYKLIELIHGKDTVEVEEDSVSRPQLESLSGTKCKYKDCLETTKNQGEYCPKHSEVKAADEDVFRKPGLPPPASKPLRPTTKIFSSKSTSRIAGLSKSLETSSALSPSLKNKSKGIQSILKVPQPVPLIAQKPVGEMKNSCNVLHPQSPNNSNRQGCKVPFGESKYFPSSSPVNILLSSQSVSDTFVKEVLKWKYEMFLNFGQCGPPASLCQSISRPVPVRFHNYGDYFNVFFPLMVLNTFETVAQEWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSYINVQEIKLVMEIIKLIKDKRKDVSFRNIGIITHYKAQKTMIQKDLDKEFDRKGPAEVDTVDAFQGRQKDCVIVTCVRANSIQGSIGFLASLQRLNVTITRAKYSLFILGHLRTLMQLLPRSFCVHVNHSPFFSPEPKYLHWALKENQHWNQLIQDAQKRGAIIKTCDKNYRHDAVKILKLKPVLQRSLTHPPTIAPEGSRPQGGLPSSKLDSGFAKTSVAASLYHTPSDSKEITLTVTSKDPERPPVHDQLQDPRLLKRMGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 62938 - protein, 2644 aa, Homo sapiens
MSTCCWCTPGGASTIDFLKRYASNTPSGEFQTADEDLCYCLECVAEYHKARDELPFLHEVLWELETLRLINHFEKSMKAEIGDDDELYIVDNNGEMPLFDITGQDFENKLRVPLLEILKYPYLLLHERVNELCVEALCRMEQANCSFQVFDKHPGIYLFLVHPNEMVRRWAILTARNLGKVDRDDYYDLQEVLLCLFKVIELGLLESPDIYTSSVLEKGKLILLPSHMYDTTNYKSYWLGICMLLTILEEQAMDSLLLGSDKQNDFMQSILHTMEREADDDSVDPFWPALHCFMVILDRLGSKVWGQLMDPIVAFQTIINNASYNREIRHIRNSSVRTKLEPESYLDDMVTCSQIVYNYNPEKTKKDSGWRTAICPDYCPNMYEEMETLASVLQSDIGQDMRVHNSTFLWFIPFVQSLMDLKDLGVAYIAQVVNHLYSEVKEVLNQTDAVCDKVTEFFLLILVSVIELHRNKKCLHLLWVSSQQWVEAVVKCAKLPTTAFTRSSEKSSGNCSKGTAMISSLSLHSMPSNSVQLAYVQLIRSLLKEGYQLGQQSLCKRFWDKLNLFLRGNLSLGWQLTSQETHELQSCLKQIIRNIKFKAPPCNTFVDLTSACKISPASYNKEESEQMGKTSRKDMHCLEASSPTFSKEPMKVQDSVLIKADNTIEGDNNEQNYIKDVKLEDHLLAGSCLKQSSKNIFTERAEDQIKISTRKQKSVKEISSYTPKDCTSRNGPERGCDRGIIVSTRLLTDSSTDALEKVSTSNEDFSLKDDALAKTSKRKTKVQKDEICAKLSHVIKKQHRKSTLVDNTINLDENLTVSNIESFYSRKDTGVQKGDGFIHNLSLDPSGVLDDKNGEQKSQNNVLPKEKQLKNEELVIFSFHENNCKIQEFHVDGKELIPFTEMTNASEKKSSPFKDLMTVPESRDEEMSNSTSVIYSNLTREQAPDISPKSDTLTDSQIDRDLHKLSLLAQASVITFPSDSPQNSSQLQRKVKEDKRCFTANQNNVGDTSRGQVIIISDSDDDDDERILSLEKLTKQDKICLEREHPEQHVSTVNSKEEKNPVKEEKTETLFQFEESDSQCFEFESSSEVFSVWQDHPDDNNSVQDGEKKCLAPIANTTNGQGCTDYVSEVVKKGAEGIEEHTRPRSISVEEFCEIEVKKPKRKRSEKPMAEDPVRPSSSVRNEGQSDTNKRDLVGNDFKSIDRRTSTPNSRIQRATTVSQKKSSKLCTCTEPIRKVPVSKTPKKTHSDAKKGQNRSSNYLSCRTTPAIVPPKKFRQCPEPTSTAEKLGLKKGPRKAYELSQRSLDYVAQLRDHGKTVGVVDTRKKTKLISPQNLSVRNNKKLLTSQELQMQRQIRPKSQKNRRRLSDCESTDVKRAGSHTAQNSDIFVPESDRSDYNCTGGTEVLANSNRKQLIKCMPSEPETIKAKHGSPATDDACPLNQCDSVVLNGTVPTNEVIVSTSEDPLGGGDPTARHIEMAALKEGEPDSSSDAEEDNLFLTQNDPEDMDLCSQMENDNYKLIELIHGKDTVEVEEDSVSRPQLESLSGTKCKYKDCLETTKNQGEYCPKHSEVKAADEDVFRKPGLPPPASKPLRPTTKIFSSKSTSRIAGLSKSLETSSALSPSLKNKSKGIQSILKVPQPVPLIAQKPVGEMKNSCNVLHPQSPNNSNRQGCKVPFGESKYFPSSSPVNILLSSQSVSDTFVKEVLKWKYEMFLNFGQCGPPASLCQSISRPVPVRFHNYGDYFNVFFPLMVLNTFETVAQEWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSYINVQEIKLVMEIIKLIKDKRKDVSFRNIGIITHYKAQKTMIQKDLDKEFDRKGFLASLQRLNVTITRAKYSLFILGHLRTLMENQHWNQLIQDAQKRGAIIKTCDKNYRHDAVKILKLKPVLQRSLTHPPTIAPEGSRPQGGLPSSKLDSGFAKTSVAASLYHTPSDSKEITLTVTSKDPERPPVHDQLQDPRLLKRMGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 62939 - protein, 948 aa, Homo sapiens
VAQEWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSYINVQEIKLVMEIIKLIKDKRKDVSFRNIGIITHYKAQKTMIQKDLDKEFDRKGPAEVDTVDAFQGRQKDCVIVTCVRANSIQGSIGFLASLQRLNVTITRAKYSLFILGHLRTLMQLLPRSFCVHVNHSPFFSPEPKYLHWALKENQHWNQLIQDAQKRGAIIKTCDKNYRHDAVKILKLKPVLQRSLTHPPTIAPEGSRPQGGLPSSKLDSGFAKTSVAASLYHTPSDSKEITLTVTSKDPERPPVHDQLQDPRLLKRMGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 62940 - protein, 422 aa, Homo sapiens
MSTSYGCFWRRFIHGIGRSGDISAVQPKAAGSSLLNKITNSLVLDIIKLAGVHTVANCFVVPMATGMSLTLCFLTLRHKRPKAKYIIWPRIDQKSCFKSMITAGFEPVVIENVLEGDELRTDLKAVEAKVQELGPDCILCIHSTTSCFAPRVPDRLEELAVICANYDIPHIVNNAYGVQSSKCMHLIQQGARVGRIDAFVQSLDKNFMVPVGGAIIAGFNDSFIQEISKMYPGRASASPSLDVLITLLSLGSNGYKKLLKERKEMFSYLSNQIKKLSEAYNERLLHTPHNPISLAMTLKTLDEHRDKAVTQLGSMLFTRQVSGARVVPLGSMQTVSGYTFRGFMSHTNNYPCAYLNAASAIGMKMQDVDLFIKRLDRCLKAVRKERSKESDDNYDKTEDVDIEEMALKLDNVLLDTYQDASS

SEQ ID NO: 62941 - protein, 501 aa, Homo sapiens
MNRESFAAGERLVSPAYVRQGCEARRSHEHLIRLLLEKGKCPENGWDESTLELFLHELAIMDSNNFLGNCGVGEREGRVASALVARRHYRFIHGIGRSGDISAVQPKAAGSSLLNKITNSLVLDIIKLAGVHTVANCFVVPMATGMSLTLCFLTLRHKRPKAKYIIWPRIDQKSCFKSMITAGFEPVVIENVLEGDELRTDLKAVEAKVQELGPDCILCIHSTTSCFAPRVPDRLEELAVICANYDIPHIVNNAYGVQSSKCMHLIQQGARVGRIDAFVQSLDKNFMVPVGGAIIAGFNDSFIQEISKMYPGRASASPSLDVLITLLSLGSNGYKKLLKERKEMFSYLSNQIKKLSEAYNERLLHTPHNPISLAMTLKTLDEHRDKAVTQLGSMLFTRQVSGARVVPLGSMQTVSGYTFRGFMSHTNNYPCAYLNAASAIGMKMQDVDLFIKRLDRCLKAVRKERSKESDDNYDKTEDVDIEEMALKLDNVLLDTYQDASS

SEQ ID NO: 62942 - protein, 261 aa, Homo sapiens
MEGGLGRAVCLLTGASRGFGRTLAPLLASLLSPGSVLVLSARNDEALRQLEAELGAERSGLRVVRVPADLGAEAGLQQLLGALRELPRPKGLQRLLLINNAGSLGDVSKGFVDLSDSTQVNNYWALNLTSMLCLTSSVLKAFPDSPGLNRTVVNISSLCALQPFKGWALYCAGKAARDMLFQVLALEEPNVRVLNYAPGPLDTDMQQLARETSVDPDMRKGLQELKAKGKLVDCKVSAQKLLSLLEKDEFKSGAHVDFYDK

SEQ ID NO: 62943 - protein, 367 aa, Homo sapiens
MDKEYVGFAALPNQLHRKSVKKGFDFTLMVAGESGLGKSTLINSLFLTNLYEDRQVPEASARLTQTLAIERRGVEIEEGGVKVKLTLVDTPGFGDSVDCSDCWLPVVKFIEEQFEQYLRDESGLNRKNIQDSRVHCCLYFISPFGRGLRPLDVAFLRAVHEKVNIIPVIGKADALMPQETQALKQKIRDQLKEEEIHIYQFPECDSDEDEDFKRQDAEMKESIPFAVVGSCEVVRDGGNRPVRGRRYSWGTVEVENPHHCDFLNLRRMLVQTHLQDLKEVTHDLLYEGYRARCLQSLARPGARDRASRSKLSRQSATEIPLPMLPLADTEKLIREKDEELRRMQEMLEKMQAQMQQSQAQGEQSDAL

SEQ ID NO: 62944 - protein, 367 aa, Homo sapiens; identical to SEQ ID NO: 62943

SEQ ID NO: 62945 - protein, 321 aa, Homo sapiens
MMNRYYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKNSNFL

SEQ ID NO: 62946 - protein, 317 aa, Homo sapiens [sequence omitted]

SEQ ID NO: 62947 - protein, 544 aa, Homo sapiens
MASSEVARHLLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKKEPGCRFELLCIDVRACETNGGRKDAEKAPIFCKTEVPEHRRSSSQANFIKKKLEVCFDFAVICFITSIFGEQPQLLIFMEKYFQVQGQYISQSE

SEQ ID NO: 62948 - protein, 454 aa, Homo sapiens
MASSEVARHLLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKNSNFL

SEQ ID NO: 62949 - protein, 431 aa, Homo sapiens
MASSEVARHLKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKNSNFL

SEQ ID NO: 62950 - protein, 450 aa, Homo sapiens
MASSEVARHLLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKK

SEQ ID NO: 62951 - protein, 473 aa, Homo sapiens
MATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKKEPGCRFELLCIDVRACETNGGRKDAEKGREGHSARGQP

SEQ ID NO: 62952 - protein, 283 aa, Homo sapiens
MASSEVARHLLFQSHMATKTTCMSSQGSDDEQIVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKK

SEQ ID NO: 62953 - protein, 429 aa, Homo sapiens
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNASFT

SEQ ID NO: 62954 - protein, 425 aa, Homo sapiens
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKK

SEQ ID NO: 62955 - protein, 439 aa, Homo sapiens
MEERKPAHVLRSFKYAAFMNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNASFT

SEQ ID NO: 62956 - protein, 358 aa, Homo sapiens
MDPLRRSPSPCLSSQPSSPSTPPCEMLGPVGIEAVLDQLKIKAMKMGFEFNIMVVGQSGLGKSTMVNTLFKSKVWKSNPPGLGVPTPQTLQLHSLTHVIEEKGVKLKLTVTDTPGFGDQINNDNCWDPILGYINEQYEQYLQEEILITRQRHIPDTRVHCCVYFVPPTGHCLRPLDIEFLQRLCRTVNVVPVIARADSLTMEEREAFRRRIQQNLRTHCIDVYPQMCFDEDINDKILNSKLRDRIPFAVVGADQEHLVNGRCVLGRKTKWGIIEVENMAHCEFPLLRDLLIRSHLQDLKDITHNIHYENYRVIRLNESHLLPRGPGWVNLAPASPGQLTTPRTFKVCRGAHDDSDDEF

SEQ ID NO: 62957 - protein, 312 aa, Homo sapiens
MDPLRRSPSPCLSSQPSSPSTPPCEMLGPVGIEAVLDQLKIKAMKMGFEFNIMVVGQSGLGKSTMVNTLFKSKVWKSNPPGLGVPTPQTLQLHSLTHVIEEKGVKLKLTVTDTPGFGDQINNDNCLRPLDIEFLQRLCRTVNVVPVIARADSLTMEEREAFRRRIQQNLRTHCIDVYPQMCFDEDINDKILNSKLRDRIPFAVVGADQEHLVNGRCVLGRKTKWGIIEVENMAHCEFPLLRDLLIRSHLQDLKDITHNIHYENYRVIRLNESHLLPRGPGWVNLAPASPGQLTTPRTFKVCRGAHDDSDDEF

SEQ ID NO: 62958 - protein, 432 aa, Homo sapiens
MAERTMAMPTQIPADGDTQKENNIRCLTTIGHFGFECLPNQLVSRSIRQGFTFNILCVGETGIGKSTLIDTLFNTNLKDNKSSHFYSNVGLQIQTYELQESNVQLKLTVVETVGYGDQIDKEASYQPIVDYIDAQFEAYLQEELKIKRSLFEYHDSRVHVCLYFISPTGHSLKSLDLLTMKNLDSKVNIIPLIAKADTISKNDLQTFKNKIMSELISNGIQIYQLPTDEETAAQANSSVSGLLPFAVVGSTDEVKVGKRMVRGRHYPWGVLQVENENHCDFVKLRDMLLCTNMENLKEKTHTQHYECYRYQKLQKMGFTDVGPNNQPVSFQEIFEAKRQEFYDQCQREEEELKQRFMQRVKEKEATFKEAEKELQDKFEHLKMIQQEEIRKLEEEKKQLEGEIIDFYKMKAASEALQTQLSTDTKKDKHRKK

SEQ ID NO: 62959 - protein, 361 aa, Homo sapiens
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGALGHHV

SEQ ID NO: 62960 - protein, 361 aa, Homo sapiens; identical to SEQ ID NO: 62959

SEQ ID NO: 62961 - protein, 396 aa, Homo sapiens
MPWISEGRATRPCLRVPSARRGDEGLHQRDEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGALGHHV

SEQ ID NO: 62962 - protein, 361 aa, Homo sapiens; identical to SEQ ID NO: 62959

SEQ ID NO: 62963 - protein, 361 aa, Homo sapiens; identical to SEQ ID NO: 62959

SEQ ID NO: 62964 - protein, 52 aa, Homo sapiens
MSKQQPTQFINPETPGYVGFANLPNQVHRKSVKKGFEFTLMVVGESGLGKST

SEQ ID NO: 62965 - protein, 50 aa, Homo sapiens
MSKQQPTQFINPETPGYVGFANLPNQVHRKSVKKGFEFTLMVVGESGLGK

SEQ ID NO: 62966 - protein, 23 aa, Homo sapiens
MSKQQPTQFINPETPGYVGFANL

SEQ ID NO: 62967 - protein, 148 aa, Homo sapiens
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHC

SEQ ID NO: 62968 - protein, 131 aa, Homo sapiens
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLH

SEQ ID NO: 62969 - protein, 72 aa, Homo sapiens
MSKQQPTQFINPETPGYVGFANLPNQVHRKSVKKGFEFTLMVVGESGLGKSTLINSLFLTDLYPERVIPGAA

SEQ ID NO: 62970 - protein, 72 aa, Homo sapiens; identical to SEQ ID NO: 62969

SEQ ID NO: 62971 - protein, 173 aa, Homo sapiens
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHN

SEQ ID NO: 62972 - protein, 29 aa, Homo sapiens
  MOD_RES (1)..(1): Any amino acid
XEMIARMQAQMQMQMQGGDGDGGALGHHV

SEQ ID NO: 62973 - protein, 286 aa, Homo sapiens
MSKGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPVSVDTEESHDSNP

SEQ ID NO: 62974 - protein, 83 aa, Homo sapiens
MSKGLPETRTDAAMSELVPEPRPKPAVPMKPMSINSNLLGYIGIDTIIEQMRKKTMKTGFDFNIMVVAGSPLRSTSMSSTRSS

SEQ ID NO: 62975 - protein, 350 aa, Homo sapiens
MSKGLPETRTDAAMSELVPEPRPKPAVPMKPMSINSNLLGYIGIDTIIEQMRKKTMKTGFDFNIMVVGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPVSVDTEESHDSNP

SEQ ID NO: 62976 - protein, 358 aa, Homo sapiens
MSKGLPETRTDAAMSELVPEPRPKPAVPMKPMSINSNLLGYIGIDTIIEQMRKKTMKTGFDFNIMVVGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPGEGLLGTVLPPVPATPCPTAE

SEQ ID NO: 62977 - protein, 294 aa, Homo sapiens
MSKGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPGEGLLGTVLPPVPATPCPTAE

SEQ ID NO: 62978 - protein, 178 aa, Homo sapiens
MSELVPEPRPKPAVPMKPMSINSNLLGYIGIDTIIEQMRKKTMKTGFDFNIMVVGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLE

SEQ ID NO: 62979 - protein, 378 aa, Homo sapiens
MDSLAAPQDRLVEQLLSPRTQAQRRLKDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 62980 - protein, 322 aa, Homo sapiens
MVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 62981 - protein, 346 aa, Homo sapiens
MDSLAAPQDRLVEQLLSPRTQAQRRLKDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEGALRLREAAQHAHPHAYARPQGRDVRRALRELPRALHPADDQQTDPGQPHGEPHPDPAAAHPGRRD

SEQ ID NO: 62982 - protein, 149 aa, Homo sapiens
LPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDGFHEGIA

SEQ ID NO: 62983 - protein, 369 aa, Homo sapiens
MSTGLRYKSKLATPEDKQDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 62984 - protein, 378 aa, Homo sapiens; identical to SEQ ID NO: 62979

SEQ ID NO: 62985 - protein, 434 aa, Homo sapiens
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKNNPWLCTE

SEQ ID NO: 62986 - protein, 429 aa, Homo sapiens
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKNFF

SEQ ID NO: 62987 - protein, 431 aa, Homo sapiens
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKNLGFL

SEQ ID NO: 62988 - protein, 427 aa, Homo sapiens
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKN

SEQ ID NO: 62989 - protein, 427 aa, Homo sapiens; identical to SEQ ID NO: 62988

SEQ ID NO: 62990 - protein, 369 aa, Homo sapiens
MDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKK

SEQ ID NO: 62991 - protein, 457 aa, Homo sapiens
MAATDIARQVFGRRRLLLLGFETVGFSAACTEEGGHMLRRGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKK

SEQ ID NO: 62992 - protein, 427 aa, Homo sapiens; identical to SEQ ID NO: 62988

SEQ ID NO: 62993 - protein, 267 aa, Homo sapiens
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQGSSQV

SEQ ID NO: 62994 - protein, 483 aa, Homo sapiens
MAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKNRSDIGAHQPGMSLSSSKVMMTKASVEPLNCSSWWPAIQCCSCLVRDATWREGFL

SEQ ID NO: 62995 - protein, 369 aa, Homo sapiens
MNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKN

SEQ ID NO: 62996 - protein, 429 aa, Homo sapiens
MAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKN

SEQ ID NO: 62997 - protein, 442 aa, Homo sapiens
MAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKKASGWSSIYSVTIP

SEQ ID NO: 62998 - protein, 568 aa, Homo sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 62999 - protein, 196 aa, Homo sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLPLLEQKVPLSQPSADCLARCGDRLE

SEQ ID NO: 63000 - protein, 579 aa, Homo sapiens
MSDPAVNAQLDGIISDFEALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 63001 - protein, 586 aa, Homo sapiens
MKKSYSGGTRTSSGRLRRLGDSSGPALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 63002 - protein, 474 aa, Homo sapiens
MGSSFWEGLQVAVGLPQGCWPQGLDSGEPAEGGQLEAAPVCIVTRQSKETAGPTLGRGGWRQGSLRRGKGTSCRCRQLSPGHGPGRLTGCGECHRLPCRGLVSGFTGLRGQEEDDLAFCLATIGSDRQATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 63003 - protein, 422 aa, Homo sapiens
MEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 63004 - protein, 335 aa, Homo sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 63005 - protein, 422 aa, Homo sapiens; identical to SEQ ID NO: 63003

SEQ ID NO: 63006 - protein, 362 aa, Homo sapiens
MAGAGCTGTWSWLWGTATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 63007 - protein, 193 aa, Homo sapiens
MTLCPQAWLPEGSEEQLRCADHPSCGVLSAGPWGGGQASHLQRSPVGCTLPSIPIGPVPWSVSEPRGECSPPGAPGPPARHMVWPSLSPYPCPAPKGRKLQGPLPPTAQPLQAPWQLPLLEQKVPLSQPSADCWPDAGTGWNEGGVFISLPSPSHATPAPTGLQVLLMRWDLIEDKKEGEMTPTPSSPSFEKV

SEQ ID NO: 63008 - protein, 356 aa, Homo sapiens
MAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPEADPRLIESLSQMLSMGFSDEGGWLTRLLQTKNYDIGAALDTIQYSKHPPPL

SEQ ID NO: 63009 - protein, 356 aa, Homo sapiens; identical to SEQ ID NO: 63008

SEQ ID NO: 63010 - protein, 440 aa, Homo sapiens
MASLTVKAYLLGKEDAAREIRRFSFCCSPEPEAEAEAAAGPGPCERLLSRVAALFPALRPGGFQAHYRDEDGDLVAFSSDEELTMAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPEADPRLIESLSQMLSMGFSDEGGWLTRLLQTKNYDIGAALDTIQYSKHPPPL

SEQ ID NO: 63011 - protein, 356 aa, Homo sapiens; identical to SEQ ID NO: 63008

SEQ ID NO: 63012 - protein, 140 aa, Homo sapiens
MAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAES

SEQ ID NO: 63013 - protein, 296 aa, Homo sapiens
MTSSESTLKRKKSAGGTTAHRVLRRRPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPEADPRLIESLSQMLSMGFSDEGGWLTRLLQTKNYDIGAALDTIQYSKHPPPL

SEQ ID NO: 63014 - protein, 167 aa, Homo sapiens
MAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPL

SEQ ID NO: 63015 - protein, 158 aa, Homo sapiens
MMQKLLKCSRLVLALALILVLESSVQGYPTRRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 63016 - protein, 328 aa, Homo sapiens
MMSGEPLHVKTPIRDSMALSKMAGTSVYLKMDSAQPSGSFKIRGIGHFCKRWAKQGCAHFVCSSAGNAGMAAAYAARQLGVPATIVVPSTTPALTIERLKNEGATVKVVGELLDEAFELAKALAKNNPGWVYIPPFDDPLIWEGHASIVKELKETLWEKPGAIALSVGGGGLLCGVVQGLQEVGWGDVPVIAMETFGAHSFHAATTAGKLVSLPKITSVAKALGVKTVGAQALKLFQEHPIFSEVISDQEAVAAIEKFVDDEKILVEPACGAALAAVYSHVIQKLQLEGNLRTPLPSLVVIVCGGSNISLAQLRALKEQLGMTNRLPK

SEQ ID NO: 63017 - protein, 218 aa, Homo sapiens
MMSGEPLHVKTPIRDSMALSKMAGTSVYLKMDSAQPSGSFKIRGIGHFCKRWAKQGCAHFVCSSAGNAGMAAAYAARQLGVPATIVVPSTTPALTIERLKNEGATVKVVGELLDEAFELAKALAKNNPGWVYIPPFDDPLIWEGHASIVKELKETLWEKPGAIALSVGGGGLLCGVVQGLQEVGWGDVPVIAMETFGAHSFHAATTAGKLVSLPKITR

SEQ ID NO: 63018 - protein, 483 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVKSVDPKTGKEILYNLESLINSAVFPGLQGGPHNHAIAGVAVALKQAMTLEFKVYQHQVVANCRALSEALTELGYKIVTGGSDNHLILVDLRSKGTDGGRAEKVLEACSIACNKNTCPGDRSALRPSGLRLGTPALTSRGLLEKDFQKVAHFIHRGIELTLQIQSDTGVRATLKEFKERLAGDKYQAAVQALREEVESFASLFPLPGLPDF

SEQ ID NO: 63019 - protein, 125 aa, Homo sapiens [sequence omitted]

SEQ ID NO: 63020 - protein, 403 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGGSDNHLILVDLRSKGTDGGRAEKVLEACSIACNKNTCPGDRSALRPSGLRLGTPALTSRGLLEKDFQKVAHFIHRGIELTLQIQSDTGVRATLKEFKERLAGDKYQAAVQALREEVESFASLFPLPGLPDF

SEQ ID NO: 63021 - protein, 444 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVAVALKQAMTLEFKVYQHQVVANCRALSEALTELGYKIVTGGSDNHLILVDLRSKGTDGGRAEKVLEACSIACNKNTCPGDRSALRPSGLRLGTPALTSRGLLEKDFQKVAHFIHRGIELTLQIQSDTGVRATLKEFKERLAGDKYQAAVQALREEVESFASLFPLPGLPDF

SEQ ID NO: 63022 - protein, 94 aa, Homo sapiens [sequence omitted]

SEQ ID NO: 63023 - protein, 258 aa, Homo sapiens [sequence omitted]

SEQ ID NO: 63024 - protein, 446 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVKSVDPKTGKEILYNLESLINSAVFPGLQGGPHNHAIAGVAVALKQAMTLEFKVYQHQVVANCRALSEALTELGYKIVTGGSDNHLILVDLRSKGTDGGRAEKVLEACSIACNKNTCPGIELTLQIQSDTGVRATLKEFKERLAGDKYQAAVQALREEVESFASLFPLPGLPDF

SEQ ID NO: 63025 - protein, 345 aa, Homo sapiens
MGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVKSVDPKTGKEILYNLESLINSAVFPGLQGGPHNHAIAGVAVALKQAMTLEFKVYQHQVVANCRALSEALTELGYKIVTGGSDNHLILVDLRSKGTDGGRAEKVLEACSIACNKNTCPGDRSALRPSGLRLGTPALTSRGLLEKDFQKVAHFIHRGIELTLQIQSDTGVRATLKEFKERLAGDKYQAAVQALREEVESFASLFPLPGLPDF

SEQ ID NO: 63026 - protein, 504 aa, Homo sapiens
MLYFSLFWAARPLQRCGQLVRMAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNPKTGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 63027 - protein, 408 aa, Homo sapiens
MGEQRWWMKLSCCASAGPWKPLTWILHSGESMSSPTPGPQPTWPSTQPFCNLTTGSWGWTCPMGAISPTATCLTSSGYQPRPSSSSLCPISSTALAVCVSVQPKTGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 63028 - protein, 483 aa, Homo sapiens
MAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNPKTGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 63029 - protein, 483 aa, Homo sapiens; identical to SEQ ID NO: 63028

SEQ ID NO: 63030 - protein, 483 aa, Homo sapiens; identical to SEQ ID NO: 63028

SEQ ID NO: 63031 - protein, 494 aa, Homo sapiens
MLYFSLFWAARPLQRCGQLVRMAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 63032 - protein, 473 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 63033 - protein, 473 aa, Homo sapiens; identical to SEQ ID NO: 63032

SEQ ID NO: 63034 - protein, 212 aa, Homo sapiens
EHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 63035 - protein, 440 aa, Homo sapiens
MPLQRCLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 63036 - protein, 418 aa, Homo sapiens
MQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 63037 - protein, 473 aa, Homo sapiens
MATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFDVHLDLEDRLAKFMKTEEAIIYSYGFATIASAIPAYSKRGDIVFVDRAACFAIQKGLQASRSDIKLFKHNDMADLERLLKEQEIEDQKNPRKARVTRRFIVVEGLYMNTGTICPLPELVKLKYKYKARIFLEESLSFGVLGEHGRGVTEHYGINIDDIDLISANMENALASIGGFCCGRSFVIDHQRLSGQGYCFSASLPPLLAAAAIEALNIMEENPGIFAVLKEKCGQIHKALQGISGLKVVGESLSPAFHLQLEESTGSREQDVRLLQEIVDQCMNRSIALTQARYLEKEEKCLPPPSIRVVVTVEQTEEELERAASTIKEVAQAVLL

SEQ ID NO: 63038 - protein, 143 aa, Homo sapiens
MATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFE

SEQ ID NO: 63039 - protein, 562 aa, Homo sapiens
MRPEPGGCCCRRTVRANGCVANGEVRNGYVRSSAAAAAAAAAGQIHHVTQNGGLYKRPFNEAFEETPMLVAVLTYVGYGVLTLFGYLRDFLRYWRIEKCHHATEREEQKDFVSLYQDFENFYTRNLYMRIRDNWNRPICSVPGARVDIMERQSHDYNWSFKYTGNIIKGVINMGSYNYLGFARNTGSCQEAAAKVLEEYGAGVCSTRQEIGNLDKHEELEELVARFLGVEAAMAYGMGFATNSMNIPALVGKGCLILSDELNHASLVLGARLSGATIRIFKHNNMQSLEKLLKDAIVYGQPRTRRPWKKILILVEGIYSMEGSIVRLPEVIALKKKYKAYLYLDEAHSIGALGPTGRGVVEYFGLDPEDVDVMMGTFTKSFGASGGYIGGKKELIDYLRTHSHSAVYATSLSPPVVEQIITSMKCIMGQDGTSLGKECVQQLAENTRYFRRRLKEMGFIIYGNEDSPVVPLMLYMPAKIGAFGREMLKRNIGVVVVGFPATPIIESRARFCLSAAHTKEILDTALKEIDEVGDLLQLKYSRHRLVPLLDRPFDETTYEETED

SEQ ID NO: 63040 - protein, 329 aa, Homo sapiens
MANPGGGAVCNGKLHNHKKQSNGSQSRNCTKNGIVKEAQQNGKPHFYDKLIVESFEEAPLHVMVFTYMGYGIGTLFGYLRDFLRNWGIEKCNAAVERKEQKDFVPLYQDFENFYTRNLYMRIRDNWNRPICSAPGPLFDLMERVSDDYNWTFRFTGRVIKDVINMGSYNFLGLAAKYDESMRTIKDVLEVYGTGVASTRHEMGTLDKHKELEDLVAKFLNVEAAMVFGMGFATNSMNIPALVGKGCLILSDELNHTSLVLGARLSGATIRIFKHNNTQSLEKLLRDAVIYGQPRTRRAWKKILILVEGVYRTSWIIYGFTRIVLFMLHP

SEQ ID NO: 63041 - protein, 552 aa, Homo sapiens
MANPGGGAVCNGKLHNHKKQSNGSQSRNCTKNGIVKEAQQNGKPHFYDKLIVESFEEAPLHVMVFTYMGYGIGTLFGYLRDFLRNWGIEKCNAAVERKEQKDFVPLYQDFENFYTRNLYMRIRDNWNRPICSAPGPLFDLMERVSDDYNWTFRFTGRVIKDVINMGSYNFLGLAAKYDESMRTIKDVLEVYGTGVASTRHEMGTLDKHKELEDLVAKFLNVEAAMVFGMGFATNSMNIPALVGKGCLILSDELNHTSLVLGARLSGATIRIFKHNNTQSLEKLLRDAVIYGQPRTRRAWKKILILVEGVYSMEGSIVHLPQIIALKKKYKAYLYIDEAHSIGAVGPTGRGVTEFFGLDPHEVDVLMGTFTKSFGASGGYIAGRKDLVDYLRVHSHSAVYASSMSPPIAEQIIRSLKLIMGLDGTTQGLQRVQQLAKNTRYFRQRLQEMGFIIYGNENASVVPLLLYMPGKVAAFARHMLEKKIGVVVVGFPATPLAEARARFCVSAAHTREMLDTVLEALDEMGDLLQLKYSRHKKSARPELYDETSFELED

SEQ ID NO: 63042 - protein, 121 aa, Homo sapiens
  MOD_RES (1)..(1): Any amino acid
XSPPIAEQIIRSLKLIMGLDGTTQGLQRVQQLAKNTRYFRQRLQEMGFIIYGNENASVVPLLLYMPGKVAAFARHMLEKKIGVVVVGFPATPLAEARARFCVSAAHTREMLDTVICCVMKI

SEQ ID NO: 63043 - protein, 139 aa, Homo sapiens
MANPGGGAVCNGKLHNHKKQSNGSQSRNCTKNGIVKEAQQNGKPHFYDKLIVESFEEAPLHVMVFTYMGYGIGTLFGYLRDFLRNWGIEKCNAAVERKEQKDFVPLYQDFENFYTRNLYMRIRDNWNRPICSAPGPLFD

SEQ ID NO: 63044 - protein, 215 aa, Homo sapiens
NCTKNGIVKEAQQNGKPHFYDKLIVESFEEAPLHVMVFTYMGYGIGTLFGYLRDFLRNWGIEKCNAAVERKEQKDFVPLYQDFENFYTRNLYMRIRDNWNRPICSAPGPLFDLMERVSDDYNWTFRFTGRVIKDVINMGSYNFLGLAAKYDESMRTIKDVLEVYGTGVASTRHEMGEFTSSWQNALCVGGVLQADSVPQGPPWSWKMGRHSSLLE

SEQ ID NO: 63045 - protein, 119 aa, Homo sapiens
MALSVLRLALLLLAVTFAGSARSGPGERGPPEKSGFGSQTGGGPCPAPGGLGDASLIPQFGLFSKYRTPNCSQYRLPGCPRHFNPVCGSDMSTYANECTLCMKIREGGHNIKIIRNGPC

SEQ ID NO: 63046 - protein, 134 aa, Homo sapiens
MALSVLRLALLLLAVTFAGSARSGPGERGPPEKSGFGSQTGGGPCPAPGGLGDGTRAPVTGGSPEDLPASLIPQFGLFSKYRTPNCSQYRLPGCPRHFNPVCGSDMSTYANECTLCMKIREGGHNIKIIRNGPC

SEQ ID NO: 63047 - protein, 79 aa, Homo sapiens
MKVTGIFLLSALALLSLSGNTGADSLGREAKCYNELNGCTKIYDPVCGTDGNTYPNECVLCFENRKRQTSILIQKSGPC

SEQ ID NO: 63048 - protein, 84 aa, Homo sapiens
MALSVLRLALLLLAVTFAASLIPQFGLFSKYRTPNCSQYRLPGCPRHFNPVCGSDMSTYANECTLCMKIREGGHNIKIIRNGPC

SEQ ID NO: 63049 - protein, 86 aa, Homo sapiens
MAVRQWVIALALAALLVVDREVPVAAGKLPFSRMPICEHMVESPTCSQMSNLVCGTDGLTYTNECQLCLARIKTKQDIQIMKDGKC

SEQ ID NO: 63050 - protein, 109 aa, Homo sapiens
MILGIGSSPHLLWTLEGTHIWSLLGDASHTDRLPEAGAGKLLSEVPVAAGKLPFSRMPICEHMVESPTCSQMSNLVCGTDGLTYTNECQLCLARIKTKQDIQIMKDGKC

SEQ ID NO: 63051 - protein, 109 aa, Homo sapiens; identical to SEQ ID NO: 63050

SEQ ID NO: 63052 - protein, 1064 aa, Homo sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 63053 - protein, 1094 aa, Homo sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDQCRQVQNEAEDAKFRQPGRSLASVARMSTDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 63054 - protein, 916 aa, Homo sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKVIY

SEQ ID NO: 63055 - protein, 86 aa, Homo sapiens
MRATAIVLLLALTLATMFSIECAKQTKQMVDCSHYKKLPPGQQRFCHHMYDPICGSDGKTYKNDCFFCSKVKKTDGTLKFVHFGKC

SEQ ID NO: 63056 - protein, 252 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 63057 - protein, 195 aa, Homo sapiens
MAQLCGLRRSRAFLALLGSLLLSGVLAADRERSIHENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 63058 - protein, 89 aa, Homo sapiens
MQLQASLSFLLILTLCLELRSELARDTIKDLLPNVCAFPMEKGPCQTYMTRWFFNFETGECELFAYGGCGGNSNNFLRKEKCEKFCKFT

SEQ ID NO: 63059 - protein, 340 aa, Homo sapiens
MCAQYCISFADVEKAHINIRDSIHLTPVLTSSILNQLTGRNLFFKCELFQKTGSFKIRGALNAVRSLVPDALERKPKAVVTHSSGNHGQALTYAAKLEGIPAYIVVPQTAPDCKKLAIQAYGASIVYCEPSDESRENVAKRVTEETEGIMVHPNQEPAVIAGQGTIALEVLNQVPLVDALVVPVGGGGMLAGIAITVKALKPSVKVYAAEPSNADDCYQSKLKGKLMPNLYPPETIADGVKSSIGLNTWPIIRDLVDDIFTVTEDEIKCATQLVWERMKLLIEPTAGVGVAAVLSQHFQTVSPEVKNICIVLSGGNVDLTSSITWVKQAERPASYQSVSV

SEQ ID NO: 63060 - protein, 545 aa, Homo sapiens
MAEPSGSPVHVQLPQQAAPVTAAAAAAPAAATAAPAPAAPAAPAPAPAPAAQAVGWPICRDAYELQEVIGSGATAVVQAALCKPRQERVAIKRINLEKCQTSMDELLKEIQAMSQCSHPNVVTYYTSFVVKDELWLVMKLLSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEIAVSASTIPEQIQSLSVHDSQGPPNANEDYREASSCAVNLVLRLRNSRKELNDIRFEFTPGRDTADGVSQELFSAGLVDGHDVVIVAANLQKIVDDPKALKTLTFKLASGCDGSEIPDEVKLIGFAQLSVS

SEQ ID NO: 63061 - protein, 904 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 63062 - protein, 913 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 63063 - protein, 916 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 63064 - protein, 318 aa, Homo sapiens
MGELWPLLLSAQENIAGIPSAFLELKKEEIKQRQIEQEKLASMKKQDEDKDKRDKEEKESSREKRERSRSPRRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRFSGILPPKVNSAEEDVRQHPCLGVAHHPLHLVHGHHQRSLPRGHPAPLGKLVGYLLQQVLQGEGTGHHLLQLHHPKLGIPLHPSSQTVQEKVVFLCLQGELQ

SEQ ID NO: 63065 - protein, 2752 aa, Homo sapiens
MYNGIGLPTPRGSGTNGYVQRNLSLVRGRRGERPDYKGEEELRRLEAALVKRPNPDILDHERKRRVELRCLELEEMMEEQGYEEQQIQEKVATFRLMLLEKDVNPGGKEETPGQRPAVTETHQLAELNEKKNERLRAAFGISDSYVDGSSFDPQRRAREAKQPAPEPPKPYSLVRESSSSRSPTPKQKKKKKKKDRGRRSESSSPRRERKKSSKKKKHRSESESKKRKHRSPTPKSKRKSKDKKRKRSRSTTPAPKSRRAHRSTSADSASSSDTSRSRSRSAAAKTHTTALAGRSPSPASGRRGEGDAPFSEPGTTSTQRPSSPETATKQPSSPYEDKDKDKKEKSATRPSPSPERSSTGPEPPAPTPLLAERHGGSPQPLATTPLSQEPVNPPSEASPTRDRSPPKSPEKLPQSSSSESSPPSPQPTKVSRHASSSPESPKPAPAPGSHREISSSPTSKNRSHGRAKRDKSHSHTPSRRMGRSRSPATAKRGRSRSRTPTKRGHSRSRSPQWRRSRSAQRWGRSRSPQRRGRSRSPQRPGWSRSRNTQRRGRSRSARRGRSHSRSPATRGRSRSRTPARRGRSRSRTPARRRSRSRTPTRRRSRSRTPARRGRSRSRTPARRRSRTRSPVRRRSRSRSPARRSGRSRSRTPARRGRSRSRTPARRGRSRSRTPARRSGRSRSRTPARRGRSRSRTPRRGRSRSRSLVRRGRSHSRTPQRRGRSGSSSERKNKSRTSQRRSRSNSSPEMKKSRISSRRSRSLSSPRSKAKSRLSLRRSLSGSSPCPKQKSQTPPRRSRSGSSQPKAKSRTPPRRSRSSSSPPPKQKSKTPSRQSHSSSSPHPKVKSGTPPRQGSITSPQANEQSVTPQRRSCFESSPDPELKSRTPSRHSCSGSSPPRVKSSTPPRQSPSRSSSPQPKVKAIISPRQRSHSGSSSPSPSRVTSRTTPRRSRSVSPCSNVESRLLPRYSHSGSSSPDTKVKPETPPRQSHSGSISPYPKVKAQTPPGPSLSGSKSPCPQEKSKDSLVQSCPGSLSLCAGVKSSTPPGESYFGVSSLQLKGQSQTSPDHRSDTSSPEVRQSHSESPSLQSKSQTSPKGGRSRSSSPVTELASRSPIRQDRGEFSASPMLKSGMSPEQSRFQSDSSSYPTVDSNSLLGQSRLETAESKEKMALPPQEDATASPPRQKDKFSPFPVQDRPESSLVFKDTLRTPPRERSGAGSSPETKEQNSALPTSSQDEELMEVVEKSEEPAGQILSHLSSELKEMSTSNFESSPEVEERPAVSLTLDQSQSQASLEAVEVPSMASSWGGPHFSPEHKELSNSPLRENSFGSPLEFRNSGPLGTEMNTGFSSEVKEDLNGPFLNQLETDPSLDMKEQSTRSSGHSSSELSPDAVEKAGMSSNQSISSPVLDAVPRTPSRERSSSASSPEMKDGLPRTPSRRSRSGSSPGLRDGSGTPSRHSLSGSSPGMKDIPRTPSRGRSECDSSPEPKALPQTPRPRSRSPSSPELNNKCLTPQRERSGSESSVDQKTVARTPLGQRSRSGSSQELDVKPSASPQERSESDSSPDSKAKTRTPLRQRSRSGSSPEVDSKSRLSPRRSRSGSSPEVKDKPRAAPRAQSGSDSSPEPKAPAPRALPRRSRSGSSSKGRGPSPEGSSSTESSPEHPPKSRTARRGSRSSPEPKTKSRTPPRRRSSRSSPELTRKARLSRRSRSASSSPETRSRTPPRHRRSPSVSSPEPAEKSRSSRRRRSASSPRTKTTSRRGRSPSPKPRGLQRSRSRSRREKTRTTRRRDRSGSSQSTSRRRQRSRSRSRVTRRRRGGSGYHSRSPARQESSRTSSRRRRGRSRTPPTSRKRSRSRTSPAPWKRSRSRASPATHRRSRSRTPLISRRRSRSRTSPVSRRRSRSRTSVTRRRSRSRASPVSRRRSRSRTPPVTRRRSRSRTPTTRRRSRSRTPPVTRRRSRSRTPPVTRRRSRSRTSPITRRRSRSRTSPVTRRRSRSRTSPVTRRRSRSRTSPVTRRRSRSRTPPAIRRRSRSRTPLLPRKRSRSRSPLAIRRRSRSRTPRTARGKRSLTRSPPAIRRRSASGSSSDRSRSATPPATRNHSGSRTPPVALNSSRMSCFSRPSMSPTPLDRCRSPGMLEPLGSSRTPMSVLQQAGGSMMDGPGPRIPDHQRTSVPENHAQSRIALALTAISLGTARPPPSMSAAGLAARMSQVPAPVPLMSLRTAPAANLASRIPAASAAAMNLASARTPAIPTAVNLADSRTPAAAAAMNLASPRTAVAPSAVNLADPRTPTAPAVNLAGARTPAALAALSLTGSGTPPTAANYPSSSRTPQAPASANLVGPRSAHATAPVNIAGSRTAAALAPASLTSARMAPALSGANLTSPRVPLSAYERVSGRTSPPLLDRARSRTPPSAPSQSRMTSERAPSPSSRMGQAPSQSLLPPAQDQPRSPVPSAFSDQSRCLIAQTTPVAGSQSLSSGAVATTTSSAGDHNGMLSVPAPGVPHSDVGEPPASTGAQQPSALAALQPAKERRSSSSSSSSSSSSSSSSSSSSSSSSSGSSSSDSEGSSLPVQPEVALKRVPSPTPAPKEAVREGRPPEPTPAKRKRRSSSSSSSSSSSSSSSSSSSSSSSSSSSSSSSSSSSSSSSSSSPSPAKPGPQALPKPASPKKPPPGERRSRSPRKPIDSLRDSRSLSYSPVERRRPSPQPSPRDQQSSSSERGSRRGQRGDSRSPSHKRRRETPSPRPMRHRSSRSP

SEQ ID NO: 63066 - protein, 233 aa, Homo sapiens
MISFPSLQRTELEEMDLILQQEGWQLDLKRNSLGWKDLQRSSHPSPCLQAGRPLPQPTCTHRGLPKLRLSEEGDYPASASTPEPRGLIPPSGTFLRFNLDPLCCGPQPVASVSRGWVSSHHCSPENCWLTWLGELPAPFSGTPPPTAVPPGQGSRSRSPRKPIDSLRDSRSLSYSPVERRRPSPQPSPRDQQSSSSERGSRRGQRGDSRSPSHKRRRETPSPRPMRHRSSRSP

SEQ ID NO: 63067 - protein, 2334 aa, Homo sapiens
MYNGIGLPTPRGSGTNGYVQRNLSLVRGRRGERPDYKGEEELRRLEAALVKRPNPDILDHERKRRVELRCLELEEMMEEQGYEEQQIQEKVATFRLMLLEKDVNPGGKEETPGQRPAVTETHQLAELNEKKNERLRAAFGISDSYVDGSSFDPQRRAREAKQPAPEPPKPYSLVRESSSSRSPTPKQKKKKKKKDRGRRSESSSPRRERKKSSKKKKHRSESESKKRKHRSPTPKSKRKSKDKKRKRSRSTTPAPKSRRAHRSTSADSASSSDTSRSRSRSAAAKTHTTALAGRSPSPASGRRGEGDAPFSEPGTTSTQRPSSPETATKQPSSPYEDKDKDKKEKSATRPSPSPERSSTGPEPPAPTPLLAERHGGSPQPLATTPLSQEPVNPPSEASPTRDRSPPKSPEKLPQSSSSESSPPSPQPTKVSRHASSSPESPKPAPAPGSHREISSSPTSKNRSHGRAKRDKSHSHTPSRRMGRSRSPATAKRGRSRSRTPTKRGHSRSRSPQWRRSRSAQRWGRSRSPQRRGRSRSPQRPGWSRSRNTQRRGRSRSARRGRSHSRSPATRGRSRSRTPARRGRSRSRTPARRRSRSRTPTRRRSRSRTPARRGRSRSRTPARRRSRTRSPVRRRSRSRSPARRSGRSRSRTPARRGRSRSRTPARRGRSRSRTPARRSGRSRSRTPARRGRSRSRTPRRGRSRSRSLVRRGRSHSRTPQRRGRSGSSSERKNKSRTSQRRSRSNSSPEMKKSRISSRRSRSLSSPRSKAKSRLSLRRSLSGSSPCPKQKSQTPPRRSRSGSSQPKAKSRTPPRRSRSSSSPPPKQKSKTPSRQSHSSSSPHPKVKSGTPPRQGSITSPQANEQSVTPQRRSCFESSPDPELKSRTPSRHSCSGSSPPRVKSSTPPRQSPSRSSSPQPKVKAIISPRQRSHSGSSSPSPSRVTSRTTPRRSRSVSPCSNVESRLLPRYSHSGSSSPDTKVKPETPPRQSHSGSISPYPKVKAQTPPGPSLSGSKSPCPQEKSKDSLVQSCPGSLSLCAGVKSSTPPGESYFGVSSLQLKGQSQTSPDHRSDTSSPEVRQSHSESPSLQSKSQTSPKGGRSRSSSPVTELASRSPIRQDRGEFSASPMLKSGMSPEQSRFQSDSSSYPTVDSNSLLGQSRLETAESKEKMALPPQEDATASPPRQKDKFSPFPVQDRPESSLVFKDTLRTPPRERSGAGSSPETKEQNSALPTSSQDEELMEVVEKSEEPAGQILSHLSSELKEMSTSNFESSPEVEERPAVSLTLDQSQSQASLEAVEVPSMASSWGGPHFSPEHKELSNSPLRENSFGSPLEFRNSGPLGTEMNTGFSSEVKEDLNGPFLNQLETDPSLDMKEQSTRSSGHSSSELSPDAVEKAGMSSNQSISSPVLDAVPRTPSRERSSSASSPEMKDGLPRTPSRRSRSGSSPGLRDGSGTPSRHSLSGSSPGMKDIPRTPSRGRSECDSSPEPKALPQTPRPRSRSPSSPELNNKCLTPQRERSGSESSVDQKTVARTPLGQRSRSGSSQELDVKPSASPQERSESDSSPDSKAKTRTPLRQRSRSGSSPEVDSKSRLSPRRSRSGSSPEVKDKPRAAPRAQSGSDSSPEPKAPAPRALPRRSRSGSSSKGRGPSPEGSSSTESSPEHPPKSRTARRGSRSSPEPKTKSRTPPRRRSSRSSPELTRKARLSRRSRSASSSPETRSRTPPRHRRSPSVSSPEPAEKSRSSRRRRSASSPRTKTTSRRGRSPSPKPRGLQRSRSRSRREKTRTTRRRDRSGSSQSTSRRRQRSRSRSRVTRRRRGGSGYHSRSPARQESSRTSSRRRRGRSRTPPTSRKRSRSRTSPAPWKRSRSRASPATHRRSRSRTPLISRRRSRSRTSPVSRRRSRSRTSVTRRRSRSRASPVSRRRSRSRTPPVTRRRSRSRTPTTRRRSRSRTPPVTRRRSRSRTPPVTRRRSRSRTSPITRRRSRSRTSPVTRRRSRSRTSPVTRRRSRSRTSPVTRRRSRSRTPPAQDQPRSPVPSAFSDQSRCLIAQTTPVAGSQSLSSGAVATTTSSAGDHNGMLSVPAPGVPHSDVGEPPASTGAQQPSALAALQPAKERRSSSSSSSSSSSSSSSSSSSSSSSSSGSSSSDSEGSSLPVQPEVALKRVPSPTPAPKEAVREGRPPEPTPAKRKRRSSSSSSSSSSSSSSSSSSSSSSSSSSSSSSSSSSSSSSSSSSPSPAKPGPQALPKPASPKKPPPGERRSRSPRKPIDSLRDSRSLSYSPVERRRPSPQPSPRDQQSSSSERGSRRGQRGDSRSPSHKRRRETPSPRPMRHRSSRSP

SEQ ID NO: 63068 - protein, 311 aa, Homo sapiens
MLLEKDVNPGGKEETPGQRPAVTETHQLAELNEKKNERLRAAFGISDSYVDGSSFDPQRRAREAKQPAPEPPKPYSLVRESSSSRSPTPKQKKKKKKKDRGRRSESSSPRRERKKSSKKKKHRSESESKKRKHRSPTPKSKRKSKDKKRKRSRSTTPAPKSRRAHRSTSADSASSSDTSRSRSRSAAAKTHTTALAGRSPSPASGRRGEGDAPFSEPGTTSTQRPSSPETATKQPSSPYEDKDKDKKEKSATRPSPSPERSSTGPEPPAPTPLLAERHGGSPQPLATTPLSQEPVNPSPQLFMFLKGILVF

SEQ ID NO: 63069 - protein, 956 aa, Homo sapiens
RRRRLRRADRRGEAAAPGPRDSGARAAAAARPLPLGGGGRRRRVRGYEEQQIQEKVATFRLMLLEKDVNPGGKEETPGQRPAVTETHQLAELNEKKNERLRAAFGISDSYVDGSSFDPQRRAREAKQPAPEPPKPYSLVRESSSSRSPTPKQKKKKKKKDRGRRSESSSPRRERKKSSKKKKHRSESESKKRKHRSPTPKSKRKSKDKKRKRSRSTTPAPKSRRAHRSTSADSASSSDTSRSRSRSAAAKTHTTALAGRSPSPASGRRGEGDAPFSEPGTTSTQRPSSPETATKQPSSPYEDKDKDKKEKSATRPSPSPERSSTGPEPPAPTPLLAERHGGSPQPLATTPLSQEPVNPPSEASPTRDRSPPKSPEKLPQSSSSESSPPSPQPTKVSRHASSSPESPKPAPAPGSHREISSSPTSKNRSHGRAKRDKSHSHTPSRRMGRSRSPATAKRGRSRSRTPTKRGHSRSRSPQWRRSRSAQRWGRSRSPQRRGRSRSPQRPGWSRSRNTQRRGRSRSARRGRSHSRSPATRGRSRSRTPARRGRSRSRTPARRRSRSRTPTRRRSRSRTPARRGRSRSRTPARRRSRTRSPVRRRSRSRSPARRSGRSRSRTPARRGRSRSRTPARRGRSRSRTPARRSGRSRSRTPARRGRSRSRTPRRGRSRSRSLVRRGRSHSRTPQRRGRSGSSSERKNKSRTSQRRSRSNSSPEMKKSRISSRRSRSLSSPRSKAKSRLSLRRSLSGSSPCPKQKSQTPPRRSRSGSSQPKAKSRTPPRRSRSSSSPPPKQKSKTPSRQSHSSSSPHPKVKSGTPPRQGSITSPQANEQSVTPQRRSCFESSPDPELKSRTPSRHSCSGSSPPRVKSSTPPRQSPSRSSSPQPKVKAIISPRQRSHSGSSSPSPSRVTSRTTPRRSRSVSPCSNVESRLLPRYSHSGSSSPDTKVKPETPPRQSHSG

SEQ ID NO: 63070 - protein, 2011 aa, Homo sapiens
MKKSRISSRRSRSLSSPRSKAKSRLSLRRSLSGSSPCPKQKSQTPPRRSRSGSSQPKAKSRTPPRRSRSSSSPPPKQKSKTPSRQSHSSSSPHPKVKSGTPPRQGSITSPQANEQSVTPQRRSCFESSPDPELKSRTPSRHSCSGSSPPRVKSSTPPRQSPSRSSSPQPKVKAIISPRQRSHSGSSSPSPSRVTSRTTPRRSRSVSPCSNVESRLLPRYSHSGSSSPDTKVKPETPPRQSHSGSISPYPKVKAQTPPGPSLSGSKSPCPQEKSKDSLVQSCPGSLSLCAGVKSSTPPGESYFGVSSLQLKGQSQTSPDHRSDTSSPEVRQSHSESPSLQSKSQTSPKGGRSRSSSPVTELASRSPIRQDRGEFSASPMLKSGMSPEQSRFQSDSSSYPTVDSNSLLGQSRLETAESKEKMALPPQEDATASPPRQKDKFSPFPVQDRPESSLVFKDTLRTPPRERSGAGSSPETKEQNSALPTSSQDEELMEVVEKSEEPAGQILSHLSSELKEMSTSNFESSPEVEERPAVSLTLDQSQSQASLEAVEVPSMASSWGGPHFSPEHKELSNSPLRENSFGSPLEFRNSGPLGTEMNTGFSSEVKEDLNGPFLNQLETDPSLDMKEQSTRSSGHSSSELSPDAVEKAGMSSNQSISSPVLDAVPRTPSRERSSSASSPEMKDGLPRTPSRRSRSGSSPGLRDGSGTPSRHSLSGSSPGMKDIPRTPSRGRSECDSSPEPKALPQTPRPRSRSPSSPELNNKCLTPQRERSGSESSVDQKTVARTPLGQRSRSGSSQELDVKPSASPQERSESDSSPDSKAKTRTPLRQRSRSGSSPEVDSKSRLSPRRSRSGSSPEVKDKPRAAPRAQSGSDSSPEPKAPAPRALPRRSRSGSSSKGRGPSPEGSSSTESSPEHPPKSRTARRGSRSSPEPKTKSRTPPRRRSSRSSPELTRKARLSRRSRSASSSPETRSRTPPRHRRSPSVSSPEPAEKSRSSRRRRSASSPRTKTTSRRGRSPSPKPRGLQRSRSRSRREKTRTTRRRDRSGSSQSTSRRRQRSRSRSRVTRRRRGGSGYHSRSPARQESSRTSSRRRRGRSRTPPTSRKRSRSRTSPAPWKRSRSRASPATHRRSRSRTPLISRRRSRSRTSPVSRRRSRSRTSVTRRRSRSRASPVSRRRSRSRTPPVTRRRSRSRTPTTRRRSRSRTPPVTRRRSRSRTPPVTRRRSRSRTSPITRRRSRSRTSPVTRRRSRSRTSPVTRRRSRSRTSPVTRRRSRSRTPPAIRRRSRSRTPLLPRKRSRSRSPLAIRRRSRSRTPRTARGKRSLTRSPPAIRRRSASGSSSDRSRSATPPATRNHSGSRTPPVALNSSRMSCFSRPSMSPTPLDRCRSPGMLEPLGSSRTPMSVLQQAGGSMMDGPGPRIPDHQRTSVPENHAQSRIALALTAISLGTARPPPSMSAAGLAARMSQVPAPVPLMSLRTAPAANLASRIPAASAAAMNLASARTPAIPTAVNLADSRTPAAAAAMNLASPRTAVAPSAVNLADPRTPTAPAVNLAGARTPAALAALSLTGSGTPPTAANYPSSSRTPQAPASANLVGPRSAHATAPVNIAGSRTAAALAPASLTSARMAPALSGANLTSPRVPLSAYERVSGRTSPPLLDRARSRTPPSAPSQSRMTSERAPSPSSRMGQAPSQSLLPPAQDQPRSPVPSAFSDQSRCLIAQTTPVAGSQSLSSGAVATTTSSAGDHNGMLSVPAPGVPHSDVGEPPASTGAQQPSALAALQPAKERRSSSSSSSSSSSSSSSSSSSSSSSSSGSSSSDSEGSSLPVQPEVALKRVPSPTPAPKEAVREGRPPEPTPAKRKRRSSSSSSSSSSSSSSSSSSSSSSSSSSSSSSSSSSSSSSSSSSPSPAKPGPQALPKPASPKKPPPGERSLLPVSPSPRHSLPHVARGTFLKRTSGYFPPLHKSFGTPCGLQDKAPPLREWRVRLFTNGPCPPCVLLLPAPTHALCSSHTQRLAV

SEQ ID NO: 63071 - protein, 611 aa, Homo sapiens
MASVQQGEKQLFEKFWRGTFKAVATPRPESIIVASITARKPLPRTEPQNNPVVPAQDGPSEKLGQHLATEPLGTNSWERDKTCRELGATRGHSASHDKDLTPPPSSRGKKKKKKSTRKKRRRSSSYSPSPVKKKKKKSSKKHKRRRSFSKKRRHSSSSPKSKRRDEKRHKKQSRSRPRKSHRHRHHRCPSRSQSSESRPSSCESRHRGRSPEEGQKSRRRHSRRCSKTLCKDSPEAQSSRPPSQPLQMLGYLSARGVITGSGSAADLFTKTASPLTTSRGRSQEYDSGNDTSSPPSTQTSSARSRGQEKGSPSGGLSKSRELNSGNTSDSGNSFTTSSPQNKGAMLENLSPTSRGRESRGFQSPCLECAEVKKSSLVPSTARSSPMKGCSRSSSYASTRSSSHSSRSPNPRASPRYTQSRSTSSEKRSYSRSPSYSSKSGKRSPPSRSSRSRRSPSYSRYSPSRERDPKYSEKDSQQRERERARRRRRSYSPMRKRRRDSPSHLEARRITSARKRPIPYYRPSPSSSGSLSSTSSWYSSSSSRSASRSYSRSRSRSRSRRRSRTRTSSSSSSRSPSPGSRSRSRSRSRSRSRSRSQSRSYSSADSYSSTRR

SEQ ID NO: 63072 - protein, 248 aa, Homo sapiens
MSGGGVIRGPAGNNDCRIYVGNLPPDIRTKDIEDVFYKYGAIRDIDLKNRRGGPPFAFVEFEDPRDAEDAVYGRDGYDYDGYRLRVEFPRSGRGTGRGGGGGGGGGAPRGRYGPPSRRSENRVVVSGLPPSGSWQDLKDHMREAGDVCYADVYRDGTGVVEFVRKEDMTYAVRKLDNTKFRSHEGETAYIRVKVDGPRSPSYGRSRSRSRSRSRSRSRSNSRSRSYSPRRSRGSPRYSPRHSRSRSRT

SEQ ID NO: 63073 - protein, 201 aa, Homo sapiens
MSGGGVIRGPAGNNDCRIYVGNLPPDIRTKDIEDVFYKYGAIRDIDLKNRRGGPPFAFVEFEDPRDAEDAVYGRDGYDYDGYRLRVEFPRSGRGTGRGGGGGGGGGAPRGRYGPPSRRSENRVVVSGLPPSGSWQDLKDHMREAGDVCYADVYRDGTGVVEFVRKEDMTYAVRKLDNTKFRSHEVGYTRILFFDQNWIQWS

SEQ ID NO: 63074 - protein, 261 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNRPTGRPRRSRSHSDNDRFKHRNRSFSRSKSNSRSRSKSQPKKEMKAKSRSRSASHTKTRGTSKTDSKTHYKSGSRYEKESRKKEPPRSKSQSRSQSRSRSKSRSRSWTSPKSSGH

SEQ ID NO: 63075 - protein, 183 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDRPNCSWNTQYSSAYYTSRKI

SEQ ID NO: 63076 - protein, 173 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDSQVSKKKNER

SEQ ID NO: 63077 - protein, 172 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNRPTGRPRRSRSHSDNDSQVSKKKNER

SEQ ID NO: 63078 - protein, 165 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRKPNCSWNTQYSSAYYTSRKI

SEQ ID NO: 63079 - protein, 182 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNRPTGRPRRSRSHSDNDRPNCSWNTQYSSAYYTSRKI

SEQ ID NO: 63080 - protein, 262 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDRFKHRNRSFSRSKSNSRSRSKSQPKKEMKAKSRSRSASHTKTRGTSKTDSKTHYKSGSRYEKESRKKEPPRSKSQSRSQSRSRSKSRSRSWTSPKSSGH

SEQ ID NO: 63081 - protein, 424 aa, Homo sapiens
MINNHRNQALYFSEHKYFQQTQVVYQGDIFWVFLCVFCLRKECVLMQGCFSAGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 63082 - protein, 484 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 63083 - protein, 483 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKVTRDYDEEEQGYDSEKEKKEEKKPIETGSPKTKECSVEKGTGDSLRESKVNGDDHHEEDMDMSD

SEQ ID NO: 63084 - protein, 389 aa, Homo sapiens [sequence omitted]

SEQ ID NO: 63085 - protein, 484 aa, Homo sapiens; identical to SEQ ID NO: 63082

SEQ ID NO: 63086 - protein, 128 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEVKQPTRVVVHKTAFES

SEQ ID NO: 63087 - protein, 131 aa, Homo sapiens
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEVFHGSIKAAVKKILLTHEN

SEQ ID NO: 63088 - protein, 209 aa, Homo sapiens
MTSLKVDNLTYRTSPDTLRRVFEKYGRVGDVYIPRDRYTKESRGFAFVRFHDKRDAEDAMDAMDGAVLDGRELRVQMARYGRPPDSHHSRRGPPPRRYGGGGYGRRSRSPRRRRRSRSRSRSRSRSRSRSRYSRSKSRSRTRSRSRSTSKSRSARRSKSKSSSVSRSRSRSRSRSRSRSPPPVSKRESKSRSRSKSPPKSPEEEGAVSS

SEQ ID NO: 63089 - protein, 201 aa, Homo sapiens
MSYGRPPPDVEGMTSLKVDNLTYRTSPDTLRRVFEKYGRVGDVYIPRDRYTKESRGFAFVRFHDKRDAEDAMDAMDGAVLDGRELRVQMARCGGYGRRSRSPRRRRRSRSRSRSRSRSRSRSRYSRSKSRSRTRSRSRSTSKSRSARRSKSKSSSVSRSRSRSRSRSRSRSPPPVSKRESKSRSRSKSPPKSPEEEGAVSS

SEQ ID NO: 63090 - protein, 221 aa, Homo sapiens
MSYGRPPPDVEGMTSLKVDNLTYRTSPDTLRRVFEKYGRVGDVYIPRDRYTKESRGFAFVRFHDKRDAEDAMDAMDGAVLDGRELRVQMARYGRPPDSHHSRRGPPPRRYGGGGYGRRSRSPRRRRRSRSRSRSRSRSRSRSRYSRSKSRSRTRSRSRSTSKSRSARRSKSKSSSVSRSRSRSRSRSRSRSPPPVSKRESKSRSRSKSPPKSPEEEGAVSS

SEQ ID NO: 63091 - protein, 179 aa, Homo sapiens
MSYGRPPPDVEGMTSLKVDNLTYRTSPDTLRRVFEKYGRVGDVYIPRDRYTKESRGFAFVRFHDKRDAEDAMDAMDGADPGVGVVPGLAADLATAARSLGPALVLDLGRPPSPDPHEGPSPSPRRSPDLVRGPGPGLGPGVLPQCPRGNPNPGRDRRVPPSLLKRKERCPLKKMLRSPV

SEQ ID NO: 63092 - protein, 222 aa, Homo sapiens
PERRGVAPPRAEEAGASSRGSGPPLRAMSYGRPPPDVEGMTSLKVDNLTYRTSPDTLRRVFEKYGRVGDVYIPRDRYTKESRGFAFVRFHDKRDAEDAMDAMDGAVLDGRELRVQMARYGRPPDSHHSRRGPPPRRYGGGGYGRRSRSPRRRRRSRSRSRSRSRSRSRSRYSRSKSRSRTRSRSRSTSKSRSARRSKSKSSSVSRSRSRSRSRSRSRSPPPV

SEQ ID NO: 63093 - protein, 124 aa, Homo sapiens
MHRDSCPLDCKVYVGNLGNNGNKTELERAFGYYGPLRSVWVARNPPGFAFVEFEDPRDAADAVRELDGRTLCGCRVRVELSNGEKRSRNRGPPPSWGRRPRDDYRRRSPPPRRRVTIMSLLTTL

SEQ ID NO: 63094 - protein, 164 aa, Homo sapiens
MHRDSCPLDCKVYVGNLGNNGNKTELERAFGYYGPLRSVWVARNPPGFAFVEFEDPRDAADAVRELDGRTLCGCRVRVELSNGEKRSRNRGPPPSWGRRPRDDYRRRSPPPRRRSPRRRSFSRSRSRSLSRDRRRERSLSRERNHKPSRSFSRSRSRSRSNERK

SEQ ID NO: 63095 - protein, 494 aa, Homo sapiens
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKDYMRQAGEVTYADAHKGRKNEGVIEFVSYSDMKRALEKLDGTEVNGRKIRLVEDKPGSRRRRSYSRSRSHSRSRSRSRHSRKSRSRSGSSKSSHSKSRSRSRSGSRSRSKSRSRSQSRSRSKKEKSRSPSKEKSRSRSHSAGKSRSKSKDQAEEKIQNNDNVGKPKSRSPSRHKSKSKSRSRSQERRVEEEKRGSVSRGRSQEKSLRQSRSRSRSKGGSRSRSRSRSKSKDKRKGRKRSREESRSRSRSRSKSERSRKRGSKRDSKAGSSKKKKKEDTDRSQSRSPSRSVSKEREHAKSESSQREGRGESENAGTNQETRSRSRSNSKSKPNLPSESRSRSKSASKTRSRSKSRSRSASRSPSRSRSRSHSRS

SEQ ID NO: 63096 - protein, 406 aa, Homo sapiens
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKDYMRQAGEVTYADAHKGRKNEGVIEFVSYSDMKRALEKLDGTEVNGRKIRLVEDKPGSRRRRSYSRSRSHSRSRSRSRHSRKSRSRSGSSKSSHSKSRSRSRSGSRSRSKSRSRSQSRSRSKKEKSRSPSKEKSRSRSHSAGKSRSKSKDQAEEKIQNNDNVGKPKSRSPSRHKSKSKSRSRSQERRVEEEKRGSVSRGRSQEKSLRQSRSRSRSKGGSRSRSRSRSKSKDKRKGRKRSREESRSRSRSRSKSERSRKRGSLAFRPGLSYRELSNLDGSKAGMTT

SEQ ID NO: 63097 - protein, 158 aa, Homo sapiens
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKVGLPLPEQEPEPEPESEPEQEREKQEPQQGKEPQPQP

SEQ ID NO: 63098 - protein, 272 aa, Homo sapiens
MSGCRVFIGRLNPAAREKDVERFFKGYGRIRDIDLKRGFGFVEFEDPRDADDAVYELDGKELCSERVTIEHARARSRGGRGRGRYSDRFSSRRPRNDRRNAPPVRTENRLIVENLSSRVSWQDLKDFMRQAGEVTFADAHRPKLNEGVVEFASYGDLKNAIEKLSGKEINGRKIKLIEGSKRHSRSRSRSRSRTRSSSRSRSRSRSRSRKSYSRSRSRSRSRSRSKSRSVSRSPVPEKSQKRGSSSRSKSPASVDRQRSRSRSRSRSVDSGN

SEQ ID NO: 63099 - protein, 138 aa, Homo sapiens
MSGCRVFIGRLNPAAREKDVERFFKGYGRIRDIDLKRGFGFVEFEDPRDADDAVYELDGKELCSERVTIEHARARSRGGRGRGRYSDRFSSRRPRNDRRNAPPVRTENRLIVENLSSRVSWQPVCVVGLMTRSACGLS

SEQ ID NO: 63100 - protein, 272 aa, Homo sapiens; identical to SEQ ID NO: 63098

SEQ ID NO: 63101 - protein, 272 aa, Homo sapiens; identical to SEQ ID NO: 63098

SEQ ID NO: 63102 - protein, 344 aa, Homo sapiens
MPRVYIGRLSYNVREKDIQRFFSGYGRLLEVDLKNGYGFVEFEDSRDADDAVYELNGKELCGERVIVEHARGPRRDRDGYSYGSRSGGGGYSSRRTSGRDKYGPPVRTEYRLIVENLSSRCSWQDLKDFMRQAGEVTYADAHKERTNEGVIEFRSYSDMKRALDKLDGTEINGRNIRLIEDKPRTSHRRSYSGSRSRSRSRRRSRSRSRRSSRSRSRSISKSRSRSRSRSKGRSRSRSKGRKSRSKSKSKPKSDRGSHSHSRSRSKDEYEKSRSRSRSRSPKENGKGDIKSKSRSRSQSRSNSPLPVPPSKARSVSPPPKRATSRSRSRSRSKSRSRSRSSSRD

SEQ ID NO: 63103 - protein, 238 aa, Homo sapiens
MSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRSRSRSHSRSRGRRYSRSRSRSRGRRSRSASPRRSRSISLRRSRSASLRRSRSGSIKGSRYFQSPSRSRSRSRSISRPRSSRSKSRSPSPKRSRSPSGSPRRSASPERMD

SEQ ID NO: 63104 - protein, 226 aa, Homo sapiens
MSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRSRSRSHSRSRGRRYSRSRSRSRGRRSRSASPRRSRSISLRRSRSASLRRSRSGSIKGSRYFQSPSRSRSRSRSISRPRSSRSPSGSPRRSASPERMD

SEQ ID NO: 63105 - protein, 221 aa, Homo sapiens
MSGWADERGGEGDGRIYVGNLPTDVREKDLEDLFYKYGRIREIELKNRHGLVPFAFVRFEDPRDAEDAIYGRNGYDYGQCRLRVEFPRTYGGRGGWPRGGRNGPPTRRSDFRVLVSGLPPSGSWQDLKDHMREAGDVCYADVQKDGVGMVEYLRKEDMEYALRKLDDTKFRSHEGETSYIRVYPERSTSYGYSRSRSGSRGRDSPYQSRGSPHYFSPFRPY

SEQ ID NO: 63106 - protein, 968 aa, Homo sapiens
MAFANFRRILRLSTFEKRKSREYEHVRRDLDPNEVWEIVGELGDGAFGKVYKAKNKETGALAAAKVIETKSEEELEDYIVEIEILATCDHPYIVKLLGAYYHDGKLWIMIEFCPGGAVDAIMLELDRGLTEPQIQVVCRQMLEALNFLHSKRIIHRDLKAGNVLMTLEGDIRLADFGVSAKNLKTLQKRDSFIGTPYWMAPEVVMCETMKDTPYDYKADIWSLGITLIEMAQIEPPHHELNPMRVLLKIAKSDPPTLLTPSKWSVEFRDFLKIALDKNPETRPSAAQLLEHPFVSSITSNKALRELVAEAKAEVMEEIEDGRDEGEEEDAVDAASTLENHTQNSSEVSPPSLNADKPLEESPSTPLAPSQSQDSVNEPCSQPSGDRSLQTTSPPVVAPGNENGLAVPVPLRKSRPVSMDARIQVAQEKQVAEQGGDLSPAANRSQKASQSRPNSSALETLGGEKLANGSLEPPAQAAPGPSKRDSDCSSLCTSESMDYGTNLSTDLSLNKEMGSLSIKDPKLYKKTLKRTRKFVVDGVEVSITTSKIISEDEKKDEEMRFLRRQELRELRLLQKEEHRNQTQLSNKHELQLEQMHKRFEQEINAKKKFFDTELENLERQQKQQVEKMEQDHAVRRREEARRIRLEQDRDYTRFQEQLKLMKKEVKNEVEKLPRQQRKESMKQKMEEHTQKKQLLDRDFVAKQKEDLELAMKRLTTDNRREICDKERECLMKKQELLRDREAALWEMEEHQLQERHQLVKQQLKDQYFLQRHELLRKHEKEREQMQRYNQRMIEQLKVRQQQEKARLPKIQRSEGKTRMAMYKKSLHINGGGSAAEQREKIKQFSQQEEKRQKSERLQQQQKHENQMRDMLAQCESNMSELQQLQNEKCHLLVEHETQKLKALDESHNQNLKEWRDKLRPRKKALEEDLNQKKREQEMFFKLSEEAECPNPSTPSKAAKFFPYSSADAS

SEQ ID NO: 63107 - protein, 968 aa, Homo sapiens; identical to SEQ ID NO: 63106

SEQ ID NO: 63108 - protein, 1099 aa, Homo sapiens
RFGSAPQRPVAMTTAQRDSLLWKLAGLLRESGDVVLSGCSTLSLLTPTLQQLNHVFELHLGPWGPGQTGFVALPSHPADSPVILQLQFLFDVLQKTLSLKLVHVAGPGPTGPIKIFPFKSLRHLELRGVPLHCLHGLRGIYSQLETLICSRSLQALEELLSACGGDFCSALPWLALLSANFSYNALTALDSSLRLLSALRFLNLSHNQVQDCQGFLMDLCELHHLDISYNRLHLVPRMGPSGAALGVLILRGNELRSLHGLEQLRNLRHLDLAYNLLEGHRELSPLWLLAELRKLYLEGNPLWFHPEHRAATAQYLSPRARDAATGFLLDGKVLSLTDFQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTESPAVCPNCGSDHVVLLAVSRGTPNRERKQGEQSLAPSPSASPVCHPPGHGDHLDRAKNSPPQAPSTRDHGSWSLSPPPERCGLRSVDHRLRLFLDVEVFSDAQEEFQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGPSTCLVSLLLTPSTLFLLDEDAAGSPAEPSPPAASGEASEKVPPSGPGPAVRVREQQPLSSLSSVLLYRSAPEDLRLLFYDEVSRLESFWALRVVCQEQLTALLAWIREPWEELFSIGLRTVIQEALALDR

SEQ ID NO: 63109 - protein, 645 aa, Homo sapiens
RFGSAPQRPVAMTTAQRDSLLWKLAGLLRESGDVVLSGCSTLSLLTPTLQQLNHVFELHLGPWGPGQTGFVALPSHPADSPVILQLQFLFDVLQKTLSLKLVHVAGPGPTGPIKIFPFKSLRHLELRGVPLHCLHGLRGIYSQLETLICSRSLQALEELLSACGGDFCSALPWLALLSANFSYNALTALDSSLRLLSALRFLNLSHNQVQDCQGFLMDLCELHHLDISYNRLHLVPRMGPSGAALGVLILRGNELRSLHGLEQLRNLRHLDLAYNLLEGHRELSPLWLLAELRKFLLDGKVLSLTDFQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQVMAPRVGAQEAVGIKRARGKWQQA

SEQ ID NO: 63110 - protein, 364 aa, Homo sapiens
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 63111 - protein, 368 aa, Homo sapiens
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVCDCVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 63112 - protein, 368 aa, Homo sapiens [sequence omitted]

SEQ ID NO: 63113 - protein, 364 aa, Homo sapiens
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLGMVRKAKYRELLLSELLGRRAPVVVRLGLTYHVHDLIGAQLVDCISTTSGTLLRLPET

SEQ ID NO: 63114 - protein, 364 aa, Homo sapiens; identical to SEQ ID NO: 63110

SEQ ID NO: 63115 - protein, 364 aa, Homo sapiens; identical to SEQ ID NO: 63110

SEQ ID NO: 63116 - protein, 364 aa, Homo sapiens; identical to SEQ ID NO: 63110

SEQ ID NO: 63117 - protein, 368 aa, Homo sapiens; identical to SEQ ID NO: 63111

SEQ ID NO: 63118 - protein, 368 aa, Homo sapiens; identical to SEQ ID NO: 63111

SEQ ID NO: 63119 - protein, 368 aa, Homo sapiens; identical to SEQ ID NO: 63111

SEQ ID NO: 63120 - protein, 364 aa, Homo sapiens; identical to SEQ ID NO: 63110

SEQ ID NO: 63121 - protein, 368 aa, Homo sapiens; identical to SEQ ID NO: 63111

SEQ ID NO: 63122 - protein, 112 aa, Homo sapiens
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMS

SEQ ID NO: 63123 - protein, 321 aa, Homo sapiens
MLVCASPPPLPALTGLRDDKLTLLSSSPGLGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLGMVRKAKYRELLLSELLGRRAPVVVRLGLTYHVHDLIGAQLVDCISTTSGTLLRLPET

SEQ ID NO: 63124 - protein, 321 aa, Homo sapiens
MLVCASPPPLPALTGLRDDKLTLLSSSPGLGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 63125 - protein, 321 aa, Homo sapiens; identical to SEQ ID NO: 63124

SEQ ID NO: 63126 - protein, 321 aa, Homo sapiens; identical to SEQ ID NO: 63124

SEQ ID NO: 63127 - protein, 321 aa, Homo sapiens; identical to SEQ ID NO: 63124

SEQ ID NO: 63128 - protein, 439 aa, Homo sapiens
MQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRSIHGNQAPPDCHLAQVQAFGGSGCVLGSRSV

SEQ ID NO: 63129 - protein, 223 aa, Homo sapiens
MAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKLKEKSQACGGNLGSIEELRGAIYLAEEACPGISDTMVAQLVQRLQRYSLSGGGTSSH

SEQ ID NO: 63130 - protein, 443 aa, Homo sapiens
MDSRAQLWGLALNKRRATLPHPGGSTNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRYSLSGGGTSSH

SEQ ID NO: 63131 - protein, 431 aa, Homo sapiens
MAHSPVQSGLPGMQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRYSLSGGGTSSH

SEQ ID NO: 63132 - protein, 412 aa, Homo sapiens
MAHSPVQSGLPGMQNLKADPEELFTKLEKIGKGSFGEVFKGIDNRTQKVVAIKIIDLEEAEDEIEDIQQEITVLSQCDSPYVTKYYGSYLKLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRYSLSGGGTSSH

SEQ ID NO: 63133 - protein, 342 aa, Homo sapiens
MAHSPVQSGLPGMQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREWSSSAIGLGQK

SEQ ID NO: 63134 - protein, 996 aa, Homo sapiens
MDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSEKMTLDLKDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNGEANFDC

SEQ ID NO: 63135 - protein, 1019 aa, Homo sapiens
MWVQGHSSRASATESVSFSGIVQMDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSEKMTLDLKDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNGEANFDC

SEQ ID NO: 63136 - protein, 996 aa, Homo sapiens; identical to SEQ ID NO: 63134

SEQ ID NO: 63137 - protein, 94 aa, Homo sapiens
MDEDTHYDKVEDVVGSHIEDAVTFWAQSINRNKDIMKIGCSLSEVCPQASSVLGNLDPNKIYGGLFSEDQCWYRCKVLKIISVEKCLVRYIDYG

SEQ ID NO: 63138 - protein, 43 aa, Homo sapiens
MDEDTHYDKVEDVVGSHIEDAVTFWAQSINRNKDIMKIGCSLS

SEQ ID NO: 63139 - protein, 996 aa, Homo sapiens
MWVQGHSSRASATESVSFSGIVQMDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSEKMTLDLKDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWDDKVKSLLCSLICYRSSMTAEQVLNAECFLMPKEQSVPNPEKDTEYTLYKKEEEIKTENLDKCMEKTRNGEANFDC

SEQ ID NO: 63140 - protein, 514 aa, Homo sapiens
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 63141 - protein, 514 aa, Homo sapiens; identical to SEQ ID NO: 63140

SEQ ID NO: 63142 - protein, 448 aa, Homo sapiens
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTSTAYEKQFPATSKDNFDMCSSSFTSSKLLPAEIKGEMEKTPVTPSQGTATKYPAKSGALSRTKKKL

SEQ ID NO: 63143 - protein, 63 aa, Homo sapiens
MADSGLDKKSTKCPDCSSASQKDVLCVCSSKTRVPPVLVVEMSQTSSIGSAESLISLERKKEK

SEQ ID NO: 63144 - protein, 514 aa, Homo sapiens; identical to SEQ ID NO: 63140

SEQ ID NO: 63145 - protein, 37 aa, Homo sapiens
MADSGLDKKSTKCPDCSSASQKDVLCVCSSKTRVPPV

SEQ ID NO: 63146 - protein, 171 aa, Homo sapiens
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVK

SEQ ID NO: 63147 - protein, 29 aa, Homo sapiens
MADSGLDKKSTKCPDCSSASQKDVLCVCS

SEQ ID NO: 63148 - protein, 401 aa, Homo sapiens
METGKDGARRGTQSPERKRRSPVPRAPSTKLRPAAAARAMDPVAAEAPGEAFLARRRPEGGGGSARPRYSLLAEIGRGSYGVVYEAVAGRSGARVAVKKIRCDAPENVELALAEFWALTSLKRRHQNVVQFEECVLQRNGLAQRMSHGNKSSQLYLRLVETSLKGERILGYAEEPCYLWFVMEFCEGGDLNQYVLSRRPDPATNKSFMLQLTSAIAFLHKNHIVHRDLKPDNILITERSGTPILKVADFGLSKVCAGLAPRGKEGNQDNKNVNVNKYWLSSACGSDFYMAPEVWEGHYTAKADIFALGIIIWAMIERITFIDSETKKELLGTYIKQGTEIVPVGEALLENPKMELHIPQKRRTSMSEGIKQLLKDMLAANPQDRPDAFELETRMDQVTCAA

SEQ ID NO: 63149 - protein, 534 aa, Homo sapiens [sequence omitted]

SEQ ID NO: 63150 - protein, 162 aa, Homo sapiens
MDPVAAEAPGEAFLARRRPEGGGGSARPRYSLLAEIGRGSYGVVYEAVAGRSGARVAVKKIRCDAPENVELALAEFWALTSLKRRHQNVVQFEECVLQRNGLAQRMSHGNKSSQLYLRLVETSLKGRFLGTHSLTTSPPEDGRGYRWWPGRLAISRQLDPAM

SEQ ID NO: 63151 - protein, 1315 aa, Homo sapiens
MEKYHVLEMIGEGSFGRVYKGRRKYSAQVVALKFIPKLGRSEKELRNLQREIEIMRGLRHPNIVHMLDSFETDKEVVVVTDYAEGELFQILEDDGKLPEDQVQAIAAQLVSALYYLHSHRILHRDMKPQNILLAKGGGIKLCDFGFARAMSTNTMVLTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLPPELQVLKDEQAHRLAPKGNQSRILTQAYKRMAEEAMQKKHQNTGPALEQEDKTSKVAPGTAPLPRLGATPQESSLLAGILASELKSSWAKSGTGEVPSAPRENRTTPDCERAFPEERPEVLGQRSTDVVDLENEEPDSDNEWQHLLETTEPVPIQLKAPLTLLCNPDFCQRIQSQLHEAGGQILKGILEGASHILPAFRVLSSLLSSCSDSVALYSFCREAGLPGLLLSLLRHSQESNSLQQQSWYGTFLQDLMAVIQAYFACTFNLERSQTSDSLQVFQEAANLFLDLLGKLLAQPDDSEQTLRRDSLMCFTVLCEAMDGNSRAISKAFYSSLLTTQQVVLDGLLHGLTVPQLPVHTPQGAPQVSQPLREQSEDIPGAISSALAAICTAPVGLPDCWDAKEQVCWHLANQLTEDSSQLRPSLISGLQHPILCLHLLKVLYSCCLVSEGLCRLLGQEPLALESLFMLIQGKVKVVDWEESTEVTLYFLSLLVFRLQNLPCGMEKLGSDVATLFTHSHVVSLVSAAACLLGQLGQQGVTFDLQPMEWMAAATHALSAPAEVRLTPPGSCGFYDGLLILLLQLLTEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLRQAPHGSEFLPVVVLSVCQLLCFPFALDMDADLLIGVLADLRDSEVAAHLLQVCCYHLPLMQVELPISLLTRLALMDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 63152 - protein, 1294 aa, Homo sapiens
MEKYHVLEMIGEGSFGRVYKGRRKYSAQVVALKFIPKLGRSEKELRNLQREIEIMRGLRHPNIVHMLDSFETDKEVVVVTDYAEGELFQILEDDGKLPEDQVQAIAAQLVSALYYLHSHRILHRDMKPQNILLAKGGGIKLCDFGFARAMSTNTMVLTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLPPELQVLKDEQAHRLAPKGNQSRILTQAYKRMAEEAMQKKHQNTGPALEQEDKTSKVAPGTAPLPRLGATPQESSLLAGILASELKSSWAKSGTGEVPSAPRENRTTPDCERAFPEERPEVLGQRSTDVVDLENEEPDSDNEWQHLLETTEPVPIQLKAPLTLLCNPDFCQRIQSQLHEAGGQILKGILEGASHILPAFRVLSSLLSSCSDSVALYSFCREAGLPGLLLSLLRHSQESNSLQQQSWYGTFLQDLMAVIQAYFACTFNLERSQTSDSLQVFQEAANLFLDLLGKLLAQPDDSEQTLRRDSLMCFTVLCEAMDGNSRAISKAFYSSLLTTQQVVLDGLLHGLTVPQLPVHTPQGAPQVSQPLREQSEDIPGAISSALAAICTAPVGLPDCWDAKEQVCWHLANQLTEDSSQLRPSLISGLQHPILCLHLLKVLYSCCLVSEGLCRLLGQEPLALESLFMLIQGKVKVVDWEESTEVTLYFLSLLVFRLQNLPCGMEKLGSDVATLFTHSHVVSLVSAAACLLGQLGQQGVTFDLQPMEWMAAATHALSAPAELLTEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLRQAPHGSEFLPVVVLSVCQLLCFPFALDMDADLLIGVLADLRDSEVAAHLLQVCCYHLPLMQVELPISLLTRLALMDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 63153 - protein, 1294 aa, Homo sapiens
MEKYHVLEMIGEGSFGRVYKGRRKYSAQVVALKFIPKLGRSEKELRNLQREIEIMRGLRHPNIVHMLDSFETDKEVVVVTDYAEGELFQILEDDGKLPEDQVQAIAAQLVSALYYLHSHRILHRDMKPQNILLAKGGGIKLCDFGFARAMSTNTMVLTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLPPELQVLKDEQAHRLAPKGNQSRILTQAYKRMAEEAMQKKHQNTGPALEQEDKTSKVAPGTAPLPRLGATPQESSLLAGILASELKSSWAKSGTGEVPSAPRENRTTPDCERAFPEERPEVLGQRSTDVVDLENEEPDSDNEWQHLLETTEPVPIQLKAPLTLLCNPDFCQRIQSQLHEAGGQILKGILEGASHILPAFRVLSSLLSSCSDSVALYSFCREAGLPGLLLSLLRHSQESNSLQQQSWYGTFLQDLMAVIQAYFACTFNLERSQTSDSLQVFQEAANLFLDLLGKLLAQPDDSEQTLRRDSLMCFTVLCEAMDGNSRAISKAFYSSLLTTQQVVLDGLLHGLTVPQLPVHTPQGAPQVSQPLREQSEDIPGAISSALAAICTAPVGLPDCWDAKEQVCWHLANQLTEDSSQLRPSLISGLQHPILCLHLLKVLYSCCLVSEGLCRLLGQEPLALESLFMLIQGKVKVVDWEESTEVTLYFLSLLVFRLQNLPCGMEKLGSDVATLFTHSHVVSLVSAAACLLGQLGQQGVTFDLQPMEWMAAATHALSAPAEMSCEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLRQAPHGSEFLPVVVLSVCQLLCFPFALDMDADLLIGVLADLRDSEVAAHLLQVCCYHLPLMQVELPISLLTRLALMDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 63154 - protein, 279 aa, Homo sapiens
MEKYHVLEMIGEGSFGRVYKGRRKYSAQVVALKFIPKLGRSEKELRNLQREIEIMRGLRHPNIVHMLDSFETDKEVVVVTDYAEGELFQILEDDGKLPEDQVQAIAAQLVSALYYLHSHRILHRDMKPQNILLAKGGGIKLCDFGFARAMSTNTMVLTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLPP

SEQ ID NO: 63155 - protein, 1315 aa, Homo sapiens; identical to SEQ ID NO: 63151

SEQ ID NO: 63156 - protein, 465 aa, Homo sapiens
MAMTGSTPCSSMSNHTKERVTMTKVTLENFYSNLIAQHEEREMRQKKLEKVMEEEGLKDEEKRLRRSAHARKETEFLRLKRTRLGLEDFESLKVIGRGAFGEVRLVQKKDTGHVYAMKILRKADMLEKEQVGHIRAERDILVEADSLWVVKMFYSFQDKLNLYLIMEFLPGGDMMTLLMKKDTLTEEETQFYIAETVLAIDSIHQLGFIHRDIKPDNLLLDSKGHVKLSDFGLCTGLKKAHRTEFYRNLNHSLPSDFTFQNMNSKRKAETWKRNRRQLAFSTVGTPDYIAPEVFMQTGYNKLCDWWSLGVIMYEMLIGYPPFCSETPQETYKKVMNWKETLTFPPEVPISEKAKDLILRFCCEWEHRIGAPGVEEIKSNSFFEGVDWEHIRERPAAISIEIKSIDDTSNFDEFPESDILKPTVATSNHPETDYKNKDWVFINYTYKRFEGLTARGAIPSYMKAAK

SEQ ID NO: 63157 - protein, 462 aa, Homo sapiens
METVQLRNPPRRQLKKLDEDSLTKQPEEVFDVLEKLGEGSYGSVYKAIHKETGQIVAIKQVPVESDLQEIIKEISIMQQCDSPHVVKYYGSYFKNTDLWIVMEYCGAGSVSDIIRLRNKTLTEDEIATILQSTLKGLEYLHFMRKIHRDIKAGNILLNTEGHAKLADFGVAGQLTDTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMKRRDETMQPAKPSFLEYFEQKEKENQINSFGKSVPGPLKNSSDWKIPQDGDYEFKTSQEQQSGKDICIQNCQGNLLCRYAF

SEQ ID NO: 63158 - protein, 487 aa, Homo sapiens
METVQLRNPPRRQLKKLDEDSLTKQPEEVFDVLEKLGEGSYGSVYKAIHKETGQIVAIKQVPVESDLQEIIKEISIMQQCDSPHVVKYYGSYFKNTDLWIVMEYCGAGSVSDIIRLRNKTLTEDEIATILQSTLKGLEYLHFMRKIHRDIKAGNILLNTEGHAKLADFGVAGQLTDTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMKRRDETMQPAKPSFLEYFEQKEKENQINSFGKSVPGPLKNSSDWKIPQDGDYEFLKSWTVEDLQKRLLALDPMMEQEIEEIRQKYQSKRQPILDAIEAKKRRQQNF

SEQ ID NO: 63159 - protein, 462 aa, Homo sapiens; identical to SEQ ID NO: 63157

SEQ ID NO: 63160 - protein, 432 aa, Homo sapiens
METVQLRNPPRRQLKKLDEDSLTKQPEEVFDVLEKLGEGSYGSVYKAIHKETGQIVAIKQVPVESDLQEIIKEISIMQQCDSPHVVKYYGSYFKNTDLWIVMEYCGAGSVSDIIRLRNKTDTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMKRRDETMQPAKPSFLEYFEQKEKENQINSFGKSVPGPLKNSSDWKIPQDGDYEFLKSWTVEDLQKRLLALDPMMEQEIEEIRQKYQSKRQPILDAIEAKKRRQQNF

SEQ ID NO: 63161 - protein, 417 aa, Homo sapiens
MKRRASDRGAGETSARAKALGSGISGNNAKRAGPFILGPRLGNSPVPSIVQCLARKDGTDDFYQLKILTLEERGDQGIESQEERQGKMLLHTEYSLLSLLHTQDGVVHHHGLFQDRTCEIVEDTESSRMVKKMKKRICLVLDCLCAHDFSDKTADLINLQHYVIKEKRLSERETVVIFYDVVRVVEALHQKNIVHRDLKLGNMVLNKRTHRITITNFCLGKHLVSEGDLLKDQRGSPAYISPDVLSGRPYRGKPSDMWALGVVLFTMLYGQFPFYDSIPQELFRKIKAAEYTIPEDGRVSENTVCLIRKLLVLDPQQRLAAADVLEALSAIIASWQSLSSLSGPLQVVPDIDDQMSNADSSQEVSWGGQMGHYPAPRDRLLGAGRARAEVAATRRPQSFLGLLPQPWGGKGRLQSSA

SEQ ID NO: 63162 - protein, 435 aa, Homo sapiens
MKRRASDRGAGETSARAKALGSGISGNNAKRAGPFILGPRLGNSPVPSIVQCLARKDGTDDFYQLKILTLEERGDQGIESQEERQGKMLLHTEYSLLSLLHTQDGVVHHHGLFQDRTCEIVEDTESSRMVKKMKKRICLVLDCLCAHDFSDKTADLINLQHYVIKEKRLSERETVVIFYDVVRVVEALHQKNIVHRDLKLGNMVLNKRTHRITITNFCLGKHLVSEGDLLKDQRGSPAYISPDVLSGRPYRGKPSDMWALGVVLFTMLYGQFPFYDSIPQELFRKIKAAEYTIPEDGRVSENTVCLIRKLLVLDPQQRLAAADVLEALSAIIASWQSLSSLSGPLQVVPDIDDQMSNADSSQEAKVTEECSQYEFENYMRQQLLLAEEKSSIHDARSWVPKRQFGSAPPVRRLGHDAQPMTSLDTAILAQRYLRK

SEQ ID NO: 63163 - protein, 440 aa, Homo sapiens
MKRRASDRGAGETSARAKALGSGISGNNAKRAGPFILALCAVGPRLGNSPVPSIVQCLARKDGTDDFYQLKILTLEERGDQGIESQEERQGKMLLHTEYSLLSLLHTQDGVVHHHGLFQDRTCEIVEDTESSRMVKKMKKRICLVLDCLCAHDFSDKTADLINLQHYVIKEKRLSERETVVIFYDVVRVVEALHQKNIVHRDLKLGNMVLNKRTHRITITNFCLGKHLVSEGDLLKDQRGSPAYISPDVLSGRPYRGKPSDMWALGVVLFTMLYGQFPFYDSIPQELFRKIKAAEYTIPEDGRVSENTVCLIRKLLVLDPQQRLAAADVLEALSAIIASWQSLSSLSGPLQVVPDIDDQMSNADSSQEAKVTEECSQYEFENYMRQQLLLAEEKSSIHDARSWVPKRQFGSAPPVRRLGHDAQPMTSLDTAILAQRYLRK

SEQ ID NO: 63164 - protein, 435 aa, Homo sapiens; identical to SEQ ID NO: 63162

SEQ ID NO: 63165 - protein, 363 aa, Homo sapiens
MAMRQTPLTCSGHTRPVVDLAFSGITPYGYFLISACKGAGQHLPRLSGQHDGKPMLRQGDTGDWIGTFLGHKGAVWGATLNKDATKAATAAADFTAKVWDAVSGDELMTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 63166 - protein, 350 aa, Homo sapiens
MAMRQTPLTCSGHTRPVVDLAFSGITPYGYFLISACKDGKPMLRQGDTGDWIGTFLGHKGAVWGATLNKDATKAATAAADFTAKVWDAVSGDELMTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 63167 - protein, 256 aa, Homo sapiens
MTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 63168 - protein, 568 aa, Homo sapiens
MKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 63169 - protein, 670 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 63170 - protein, 713 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 63171 - protein, 360 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKHPSQ

SEQ ID NO: 63172 - protein, 414 aa, Homo sapiens
LLDASEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 63173 - protein, 242 aa, Homo sapiens
MDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAEDTEECRKHINDWVAEKTEGKISEVLDAGTVDPLTKLVLVNAIYFKGKWNEQFDRKYTRGMLFKTNEEKKTVQMMFKEAKFKMGYADEVHTQVLELPYVEEELSMVILLPDDNTDLAVKE

SEQ ID NO: 63174 - protein, 444 aa, Homo sapiens
MKVVPSLLLSVLLAQVWLVPGLAPSPQSPETPAPQNQTSRVVQAPKEEEEDEQEASEEKASEEEKAWLMASRQQLAKETSNFGFSLLRKISMRHDGNMVFSPFGMSLAMTGLMLGATGPTETQIKRGLHLQALKPTKPGLLPSLFKGLRETLSRNLELGLTQGSFAFIHKDFDVKETFFNLSKRYFDTECVPMNFRNASQAKRLMNHYINKETRGKIPKLFDEINPETKLILVDYILFKGKWLTPFDPVFTEVDTFHLDKYKTIKVPMMYGAGKFASTFDKNFRCHVLKLPYQGNATMLVVLMEKMGDHLALEDYLTTDLVETWLRNMKTRNMEVFFPKFKLDQKYEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 63175 - protein, 444 aa, Homo sapiens; identical to SEQ ID NO: 63174

SEQ ID NO: 63176 - protein, 444 aa, Homo sapiens; identical to SEQ ID NO: 63174

SEQ ID NO: 63177 - protein, 484 aa, Homo sapiens
MSRSTQELLGYHCRLQDKLQEQEGSLAAEGRHSLASAADHMKVVPSLLLSVLLAQVWLVPGLAPSPQSPETPAPQNQTSRVVQAPKEEEEDEQEASEEKASEEEKAWLMASRQQLAKETSNFGFSLLRKISMRHDGNMVFSPFGMSLAMTGLMLGATGPTETQIKRGLHLQALKPTKPGLLPSLFKGLRETLSRNLELGLTQGSFAFIHKDFDVKETFFNLSKRYFDTECVPMNFRNASQAKRLMNHYINKETRGKIPKLFDEINPETKLILVDYILFKGKWLTPFDPVFTEVDTFHLDKYKTIKVPMMYGAGKFASTFDKNFRCHVLKLPYQGNATMLVVLMEKMGDHLALEDYLTTDLVETWLRNMKTRNMEVFFPKFKLDQKYEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 63178 - protein, 95 aa, Homo sapiens
MERMLPLLALGLLAAGFCPAVLCHPNSPLDEENLTQENQDRGTHVDLGLASANVDFAFSLYKHPHRWSIRLCLMYLRRAQKHLLPQQSKSPSFLH

SEQ ID NO: 63179 - protein, 423 aa, Homo sapiens
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 63180 - protein, 423 aa, Homo sapiens; identical to SEQ ID NO: 63179

SEQ ID NO: 63181 - protein, 423 aa, Homo sapiens; identical to SEQ ID NO: 63179

SEQ ID NO: 63182 - protein, 448 aa, Homo sapiens
MKIHYSRQTALESTSYIQLPEAELRMERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 63183 - protein, 305 aa, Homo sapiens
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEF

SEQ ID NO: 63184 - protein, 427 aa, Homo sapiens
MHLIDYLLLLLVGLLALSHGQLHVEHDGESCSNSSHQQILETGEGSPSLKIAPANADFAFRFYYLIASETPGKNIFFSPLSISAAYAMLSLGACSHSRSQILEGLGFNLTELSESDVHRGFQHLLHTLNLPGHGLETRVGSALFLSHNLKFLAKFLNDTMAVYEAKLFHTNFYDTVGTIQLINDHVKKETRGKIVDLVSELKKDVLMVLVNYIYFKALWEKPFISSRTTPKDFYVDENTTVRVPMMLQDQEHHWYLHDRYLPCSVLRMDYKGDATVFFILPNQGKMREIEEVLTPEMLMRWNNLLRKRNFYKKLELHLPKFSISGSYVLDQILPRLGFTDLFSKWADLSGITKQQKLEASKSFHKATLDVDEAGTEAAAATSFAIKFFSAQTNRHILRFNRPFLVVIFSTSTQSVLFLGKVVDPTKP

SEQ ID NO: 63185 - protein, 427 aa, Homo sapiens; identical to SEQ ID NO: 63184

SEQ ID NO: 63186 - protein, 427 aa, Homo sapiens; identical to SEQ ID NO: 63184

SEQ ID NO: 63187 - protein, 405 aa, Homo sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGTWTQPFDLASTREENFYVDETTVVKVPMMLQSSTISYLHDSELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 63188 - protein, 136 aa, Homo sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGS

SEQ ID NO: 63189 - protein, 397 aa, Homo sapiens
MDSLATSINQFALELSKKLAESAQGKNIFFSSWSISTSLTIVYLGAKGTTAAQMAQVLQFNRDQGVKCDPESEKKRKMEFNLSNSEEIHSDFQTLISEILKPNDDYLLKTANAIYGEKTYAFHNKYLEDMKTYFGAEPQPVNFVEASDQIRKDINSWVERQTEGKIQNLLPDDSVDSTTRMILVNALYFKGIWEHQFLVQNTTEKPFRINETTSKPVQMMFMKKKLHIFHIEKPKAVGLQLYYKSRDLSLLILLPEDINGLEQLEKAITYEKLNEWTSADMMELYEVQLHLPKFKLEDSYDLKSTLSSMGMSDAFSQSKADFSGMSSARNLFLSNVFHKAFVEINEQGTEAAAGSGSEIDIRIRVPSIEFNANHPFLFFIRHNKTNTILFYGRLCSP

SEQ ID NO: 63190 - protein, 339 aa, Homo sapiens
MDSLGAVSTRLGFDLFKELKKTNDGNIFFSPVGILTAIGMVLLGTRGATASQLEEVFHSEKETKSSRIKAEEKEVIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 63191 - protein, 391 aa, Homo sapiens
MDSLGAVSTRLGFDLFKELKKTNDGNIFFSPVGILTAIGMVLLGTRGATASQLEEVFHSEKETKSSRIKAEEKEVIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 63192 - protein, 309 aa, Homo sapiens
MDSLGAVSTRLGFDLFKELKKTNDGNIFFSPVGILTAIGMVLLGTRGATASQLEEVFHSEKETKSSRIKAEEKEVEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 63193 - protein, 390 aa, Homo sapiens
MNSLSEANTKFMFDLFQQFRKSKENNIFYSPISITSALGMVLLGAKDNTAQQIKKVLHFDQVTENTTGKAATYHVDRSGNVHHQFQKLLTEFNKSTDAYELKIANKLFGEKTYLFLQEYLDAIKKFYQTSVESVDFANAPEESRKKINSWVESQTNEKIKNLIPEGNIGSNTTLVLVNAIYFKGQWEKKFNKEDTKEEKFWPNKNTYKSIQMMRQYTSFHFASLEDVQAKVLEIPYKGKDLSMIVLLPNEIDGLQKLEEKLTAEKLMEWTSLQNMRETRVDLHLPRFKVEESYDLKDTLRTMGMVDIFNGDADLSGMTGSRGLVLSGVLHKAFVEVTEEGAEAAAATAVVGFGSSPTSTNEEFHCNHPFLFFIRQNKTNSILFYGRFSSP

SEQ ID NO: 63194 - protein, 390 aa, Homo sapiens
MNSLSEANTKFMFDLFQQFRKSKENNIFYSPISITSALGMVLLGAKDNTAQQISKVLHFDQVTENTTEKAATYHVDRSGNVHHQFQKLLTEFNKSTDAYELKIANKLFGEKTYQFLQEYLDAIKKFYQTSVESTDFANAPEESRKKINSWVESQTNEKIKNLFPDGTIGNDTTLVLVNAIYFKGQWENKFKKENTKEEKFWPNKNTYKSVQMMRQYNSFNFALLEDVQAKVLEIPYKGKDLSMIVLLPNEIDGLQKLEEKLTAEKLMEWTSLQNMRETCVDLHLPRFKMEESYDLKDTLRTMGMVNIFNGDADLSGMTWSHGLSVSKVLHKAFVEVTEEGVEAAAATAVVVVELSSPSTNEEFCCNHPFLFFIRQNKTNSILFYGRFSSP

SEQ ID NO: 63195 - protein, 338 aa, Homo sapiens
MNSLSEANTKFMFDLFQQFRKSKENNIFYSPISITSALGMVLLGAKDNTAQQISKVLHFDQVTENTTEKAATYHVDRSGNVHHQFQKLLTEFNKSTDAYELKIANKLFGEKTYQFLQEYLDAIKKFYQTSVESTDFANAPEESRKKINSWVESQTNEKIKNLFPDGTIGNDTTLVLVNAIYFKGQWENKFKKENTKEEKFWPNKLEEKLTAEKLMEWTSLQNMRETCVDLHLPRFKMEESYDLKDTLRTMGMVNIFNGDADLSGMTWSHGLSVSKVLHKAFVEVTEEGVEAAAATAVVVVELSSPSTNEEFCCNHPFLFFIRQNKTNSILFYGRFSSP

SEQ ID NO: 63196 - protein, 375 aa, Homo sapiens
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 63197 - protein, 129 aa, Homo sapiens
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETK

SEQ ID NO: 63198 - protein, 376 aa, Homo sapiens
MDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 63199 - protein, 181 aa, Homo sapiens
  MOD_RES (1)..(1): Any amino acid
XLNLLKTLGKDNSKNVFFSPMSMSCALAMVYMGAKGNTAAQMAQILSFNKSGGGGDIHQGFQSLLTEVNKTGTQYLLRMANRESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 63200 - protein, 376 aa, Homo sapiens; identical to SEQ ID NO: 63198

SEQ ID NO: 63201 - protein, 376 aa, Homo sapiens; identical to SEQ ID NO: 63198

SEQ ID NO: 63202 - protein, 376 aa, Homo sapiens; identical to SEQ ID NO: 63198

SEQ ID NO: 63203 - protein, 376 aa, Homo sapiens; identical to SEQ ID NO: 63198

SEQ ID NO: 63204 - protein, 376 aa, Homo sapiens; identical to SEQ ID NO: 63198

SEQ ID NO: 63205 - protein, 192 aa, Homo sapiens
MDVLAEANGTFALNLLKTLGKDNSKNVFFSPMSMSCALAMVYMGAKGNTAAQMAQILSFNKSGGGGDIHQGFQSLLTEVNKTGTQYLLRMANRESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 63206 - protein, 380 aa, Homo sapiens
MASLAAANAEFCFNLFREMDDNQGNGNVFFSSLSLFAALALVRLGAQDDSLSQIDKLLHVNTASGYGNSSNSQSGLQSQLKRVFSDINASHKDYDLSIVNGLFAEKVYGFHKDYIECAEKLYDAKVERVDFTNHLEDTRRNINKWVENETHGKIKNVIGEGGISSSAVMVLVNAVYFKGKWQSAFTKSETINCHFKSPKCSGKAVAMMHQERKFNLSVIEDPSMKILELRYNGGINMYVLLPENDLSEIENKLTFQNLMEWTNPRRMTSKYVEVFFPQFKIEKNYEMKQYLRALGLKDIFDESKADLSGIASGGRLYISRMMHKSYIEVTEEGTEATAATGSNIVEKQLPQSTLFRADHPFLFVIRKDDIILFSGKVSCP

SEQ ID NO: 63207 - protein, 380 aa, Homo sapiens; identical to SEQ ID NO: 63206

SEQ ID NO: 63208 - protein, 128 aa, Homo sapiens
MASLAAANAEFCFNLFREMDDNQGNGNVFFSSLSLFAALALVRLGAQDDSLSQIDKLLHVNTASGYGNSSNSQSGLQSQLKRVFSDINASHKDYDLSIVNGLFAEKVYGFHKDYIECAEKLYDAKVER

SEQ ID NO: 63209 - protein, 128 aa, Homo sapiens; identical to SEQ ID NO: 63208

SEQ ID NO: 63210 - protein, 165 aa, Homo sapiens
MASLAAANAEFCFNLFREMDDNQGNGNVFFSSLSLFAALALVRLGAQDDSLSQIDKLLHVNTASGYGNSSNSQSGLQSQLKRVFSDINASHKDYDLSIVNGLFAEKVYGFHKDYIECAEKLYDAKVERVDFTNHLEDTRRNINKWVENETHGKIKNVIGEGGISS

SEQ ID NO: 63211 - protein, 363 aa, Homo sapiens
MASLAAANAEFCFNLFREMDDNQGNGNVFFSSLSLFAALALVRLGAQDDSLSQIDKSGLQSQLKRVFSDINASHKDYDLSIVNGLFAEKVYGFHKDYIECAEKLYDAKVERVDFTNHLEDTRRNINKWVENETHGKIKNVIGEGGISSSAVMVLVNAVYFKGKWQSAFTKSETINCHFKSPKCSGKAVAMMHQERKFNLSVIEDPSMKILELRYNGGINMYVLLPENDLSEIENKLTFQNLMEWTNPRRMTSKYVEVFFPQFKIEKNYEMKQYLRALGLKDIFDESKADLSGIASGGRLYISRMMHKSYIEVTEEGTEATAATGSNIVEKQLPQSTLFRADHPFLFVIRKDDIILFSGKVSCP

SEQ ID NO: 63212 - protein, 380 aa, Homo sapiens; identical to SEQ ID NO: 63206

SEQ ID NO: 63213 - protein, 374 aa, Homo sapiens
MDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAEDTEECRKHINDWVAEKTEGKISEVLDAGTVDPLTKLVLVNAIYFKGKWNEQFDRKYTRGMLFKTNEEKKTVQMMFKEAKFKMGYADEVHTQVLELPYVEEELSMVILLPDDNTDLAVVEKALTYEKFKAWTNSEKLTKSKVQVFLPRLKLEESYDLEPFLRRLGMIDAFDEAKADFSGMSTEKNVPLSKVAHKCFVEVNEEGTEAAAATAVVRNSRCSRMEPRFCADHPFLFFIRHHKTNCILFCGRFSSP

SEQ ID NO: 63214 - protein, 374 aa, Homo sapiens; identical to SEQ ID NO: 63213

SEQ ID NO: 63215 - protein, 164 aa, Homo sapiens
MDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAEDTEECRKHINDWVAEKTEGKISEVLDAGTVDPLTKLVLVNA

SEQ ID NO: 63216 - protein, 124 aa, Homo sapiens
MDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAED

SEQ ID NO: 63217 - protein, 192 aa, Homo sapiens
MLFKTNEEKKTVQMMFKEAKFKMGYADEVHTQVLELPYVEEELSMVILLPDDNTDLAVVEKALTYEKFKAWTNSEKLTKSKVQVFLPRLKLEESYDLEPFLRRLGMIDAFDEAKADFSGMSTEKNVPLSKVAHKCFVEVNEEGTEAAAATAVVRNSRCSRMEPRFCADHPFLFFIRHHKTNCILFCGRFSSP

SEQ ID NO: 63218 - protein, 376 aa, Homo sapiens
METLSNASGTFAIRLLKILCQDNPSHNVFCSPVSISSALAMVLLGAKGNTATQMAQALSLNTEEDIHRAFQSLLTEVNKAGTQYLLRTANRLFGEKTCQFLSTFKESCLQFYHAELKELSFIRAAEESRKHINTWVSKKTEGKIEELLPGSSIDAETRLVLVNAIYFKGKWNEPFDETYTREMPFKINQEEQRPVQMMYQEATFKLAHVGEVRAQLLELPYARKELSLLVLLPDDGVELSTVEKSLTFEKLTAWTKPDCMKSTEVEVLLPKFKLQEDYDMESVLRHLGIVDAFQQGKADLSAMSAERDLCLSKFVHKSFVEVNEEGTEAAAASSCFVVAECCMESGPRFCADHPFLFFIRHNRANSILFCGRFSSP

SEQ ID NO: 63219 - protein, 499 aa, Homo sapiens
MKHSLNALLIFLIITSAWGGSKGPLDQLEKGGETAQSADPQWEQLNNKNLSMPLLPADFHKENTVTNDWIPEGEEDDDYLDLEKIFSEDDDYIDIVDSLSVSPTDSDVSAGNILQLFHGKSRIQRLNILNAKFAFNLYRVLKDQVNTFDNIFIAPVGISTAMGMISLGLKGETHEQVHSILHFKDFVNASSKYEITTIHNLFRKLTHRLFRRNFGYTLRSVNDLYIQKQFPILLDFKTKVREYYFAEAQIADFSDPAFISKTNNHIMKLTKGLIKDALENIDPATQMMILNCIYFKGSWVNKFPVEMTHNHNFRLNEREVVKVSMMQTKGNFLAANDQELDCDILQLEYVGGISMLIVVPHKMSGMKTLEAQLTPRVVERWQKSMTNRTREVLLPKFKLEKNYNLVESLKLMGIRMLFDKNGNMAGISDQRIAIDLFKHQGTITVNEEGTQATTVTTVGFMPLSTQVRFTVDRPFLFLIYEHRTSCLLFMGRVANPSRS

SEQ ID NO: 63220 - protein, 499 aa, Homo sapiens; identical to SEQ ID NO: 63219

SEQ ID NO: 63221 - protein, 398 aa, Homo sapiens
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITTGSENLHVSHILQKAKIEVSEDGTKASAATTAILIARSSPPWFIVDRPFLFFIRHNPTGAVLFMGQINKP

SEQ ID NO: 63222 - protein, 397 aa, Homo sapiens
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITRSENLHVSHILQKAKIEVSEDGTKASAATTAILIARSSPPWFIVDRPFLFFIRHNPTGAVLFMGQINKP

SEQ ID NO: 63223 - protein, 397 aa, Homo sapiens; identical to SEQ ID NO: 63222

SEQ ID NO: 63224 - protein, 42 aa, Homo sapiens
MNWHLPLFLLASVTLPSICSHFNPLSLEELGSNTGIQVFNQI

SEQ ID NO: 63225 - protein, 276 aa, Homo sapiens
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKT

SEQ ID NO: 63226 - protein, 409 aa, Homo sapiens
MSDCRSSLVEGTMNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITRSENLHVSHILQKAKIEVSEDGTKASAATTAILIARSSPPWFIVDRPFLFFIRHNPTGAVLFMGQINKP

SEQ ID NO: 63227 - protein, 87 aa, Homo sapiens
MNWHLPLFLLASVTLPSICSHFNPLSLEELGSNTGIQVFNQIVKSRPHDNIVISPHGIASVLGMLQLGADGRTKKQLAMVMRYGVNG

SEQ ID NO: 63228 - protein, 418 aa, Homo sapiens
MQALVLLLCIGALLGHSSCQNPASPPEEGSPDPDSTGALVEEEDPFFKVPVNKLAAAVSNFGYDLYRVRSSTSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPSPGLQPAHLTFPLDYHLNQPFIFVLRDTDTGALLFIGKILDPRGP

SEQ ID NO: 63229 - protein, 410 aa, Homo sapiens
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIPYEGDEISMMLVLSRQEVPLATLEPLVKAQLVEEWANSVKKQKVEVYLPRFTVEQEIDLKDVLKALGITEIFIKDANLTGLSDNKEIFLSKAIHKSFLEVNEEGSEAAAVSGMIAISRMAVLYPQVIVDHPFFFLIRNRRTGTILFMGRVMHPETMNTSGHDFEEL

SEQ ID NO: 63230 - protein, 410 aa, Homo sapiens; identical to SEQ ID NO: 63229

SEQ ID NO: 63231 - protein, 245 aa, Homo sapiens
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIP

SEQ ID NO: 63232 - protein, 160 aa, Homo sapiens
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTN

SEQ ID NO: 63233 - protein, 196 aa, Homo sapiens
MVGGLKRKHSDLEEEEERWEWSPAGLQSYQQALLRISLDKVQRSLGPRAPSLRRHVLIHNTLQQLQAALRLAPAPALPPEPLFLGEEDFSLSATIGSILRELDTSMDGTEPPQNPVTPLGLQNEVPPQPDPVFLEALSSRYLGDSGLDDFFLDIDTSAVEKEPARAPPEPPHNLFCAPGSWEWNELDHIMEIILGS

SEQ ID NO: 63234 - protein, 196 aa, Homo sapiens; identical to SEQ ID NO: 63233

SEQ ID NO: 63235 - protein, 122 aa, Homo sapiens
MKLLTGLVFCSLVLGVSSRSFFSFLGEAFDGARDMWRAYSDMREANYIGSDKYFHARGNYDAAKRGPGGAWAAEVITDARENIQRFFGHGAEDSLADQAANEWGRSGKDPNHFRPAGLPEKY

SEQ ID NO: 63236 - protein, 122 aa, Homo sapiens; identical to SEQ ID NO: 63235

SEQ ID NO: 63237 - protein, 122 aa, Homo sapiens; identical to SEQ ID NO: 63235

SEQ ID NO: 63238 - protein, 122 aa, Homo sapiens
MKLLTGLVFCSLVLSVSSRSFFSFLGEAFDGARDMWRAYSDMREANYIGSDKYFHARGNYDAAKRGPGGAWAAEVISNARENIQRLTGRGAEDSLADQAANKWGRSGRDPNHFRPAGLPEKY

SEQ ID NO: 63239 - protein, 83 aa, Homo sapiens
MKLLTGLVFCSLVLSVSSRSFFSFLGEAFDGARDMWRAYSDMREANYIGSDKYFHARGNYDAAKRGPGGAWAAEVISLFSAEL

SEQ ID NO: 63240 - protein, 122 aa, Homo sapiens; identical to SEQ ID NO: 63238

SEQ ID NO: 63241 - protein, 122 aa, Homo sapiens; identical to SEQ ID NO: 63238

SEQ ID NO: 63242 - protein, 130 aa, Homo sapiens
MRLFTGIVFCSLVMGVTSESWRSFFKEALQGVGDMGRAYWDIMISNHQNSNRYLYARGNYDAAQRGPGGVWAAKLISRSRVYLQGLIDCYLFGNSSTVLEDSKSNEKAEEWGRSGKDPDRFRPDGLPKKY

SEQ ID NO: 63243 - protein, 425 aa, Homo sapiens
MGEDAAQAEKFQHPGSDMRQEKPSSPSPMPSSTPSPSLNLGNTEEAIRDNSQVNAVTVLTLLDKLVNMLDAVQENQHKMEQRQISLEGSVKGIQNDLTKLSKYQASTSNTVSKLLEKSRKVSAHTRAVKERMDRQCAQVKRLENNHAQLLRRNHFKVLIFQEENEIPASVFVKQPVSGAVEGKEELPDENKSLEETLHTVDLSSDDDLPHDEEALEDSAEEKVEESRAEKIKRSSLKKVDSLKKAFSRQNIEKKMNKLGTKIVSVERREKIKKSLTSNHQKISSGKSSPFKVSPLTFGRKKVREGESHAENETKSEDLPSSEQMPNDQEEESFAEGHSEASLASALVEGEIAEEAAEKATSRGSNSGMDSNIDLTIVEDEEEESVALEQAQKVRYEGSYALTSEEAERSDGDPVQPAVLQVHQTS

SEQ ID NO: 63244 - protein, 429 aa, Homo sapiens
MAQPGTLNLNNEVVKMRKEVKRIRVLVIRKLVRSVGRLKSKKGTEDALLKNQRRAQRLLEEIHAMKELKPDIVTKSALGDDINFEKIFKKPDSTATERAIARLAVHPLLKKKIDVLKAAVQAFKEARQNVAEVESSKNASEDNHSENTLYSNDNGSNLQREATVISEQKVKETKILAKKPIHNSKEKIAKMEHGPKAVTIANSPSKPSEKDSVVSLESQKTPADPKLKTLSQTKKNKGSDSSLSGNSDGGEEFCEEEKEYFDDSTEERFYKQSSMSEDSDSGDDFFIGKVRRTRKKESSCHSSVKEQKPLEKVFLKEDTGETHGDTRNDKIKPSTETRKLESVFFHSLSGSKSSRRNFKEQAPKTRSLDFPQNEPQIKNQFNKKLSGRLENTKQQLQLPLHPSWEASRRRKEQQSNIAVFQGKKITFDD

SEQ ID NO: 63245 - protein, 431 aa, Homo sapiens
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 63246 - protein, 421 aa, Homo sapiens
MKPSKRFFISPPSSTAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 63247 - protein, 526 aa, Homo sapiens
MVNKDMNGFPVKKCSAFQFFKKRVRRWIKSPMVSVDKHQSPSLKYTGSSMVHIPPGEPDFESSLCQTCLGEHAFQRGVLPQENESCSWETQSGCEVREPCNHANILTKPDPRTFWTNDDPAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 63248 - protein, 445 aa, Homo sapiens
MGEMQGALARARLESLLRPRHKKRAEAQKRSESFLLSGLAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 63249 - protein, 144 aa, Homo sapiens
MVSVDKHQSPSLKYTGSSMVHIPPGEPDFESSLCQTCLGEHAFQRGVLPQENESCSWETQSGCEVREPCNHANILTKPDPRTFWTNDDPAFMKQRRMGLNDFIQKIANNSYACKHPEVQSILKISQPQEPELMNANPSPPPSPS

SEQ ID NO: 63250 - protein, 459 aa, Homo sapiens
MSSQSSSLSEACSREAYSSHNWALPPASRSNPQPAYPWATRRMKEEAIKPPLKAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 63251 - protein, 60 aa, Homo sapiens
MVNKDMNGFPVKKCSAFQFFKKRVRRWIKSPMVSVDKHQSPSLKYTGSSMVHIPPGEPDF

SEQ ID NO: 63252 - protein, 427 aa, Homo sapiens
MQGLLTSGRKPSGGGRCTGRGGWRGQWCLKPWMGGADPPTPTLSCLLLPVPPELPDHCYRMNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 63253 - protein, 366 aa, Homo sapiens
MNSSPAGTPSPQPSRANGNINLGPSANPNAQPTDFDFLKVIGKGNYGKVLLAKRKSDGAFYAVKVLQKKSILKKKESHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 63254 - protein, 367 aa, Homo sapiens
MNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 63255 - protein, 367 aa, Homo sapiens; identical to SEQ ID NO: 63254

SEQ ID NO: 63256 - protein, 198 aa, Homo sapiens
MNSSPAGTPSPQPSRANGNINLGPSANPNAQPTDFDFLKVIGKGNYGKVLLAKRKSDGAFYAVKVLQKKSILKKKESHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPE

SEQ ID NO: 63257 - protein, 367 aa, Homo sapiens; identical to SEQ ID NO: 63254

SEQ ID NO: 63258 - protein, 393 aa, Homo sapiens
MQGLLTSGRKPSGGGRCTELPDHCYRMNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 63259 - protein, 496 aa, Homo sapiens
MQRDHTMDYKESCPSVSIPSSDEHREKKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDPSEDEDERSSQKLHSTSQNINLGPSGNPHAKPTDFDFLKVIGKGSFGKVLLAKRKLDGKFYAVKVLQKKIVLNRKEQKHIMAERNVLLKNVKHPFLVGLHYSFQTTEKLYFVLDFVNGGELFFHLQRERSFPEHRARFYAAEIASALGYLHSIKIVYRDLKPENILLDSVGHVVLTDFGLCKEGIAISDTTTTFCGTPEYLAPEVIRKQPYDNTVDWWCLGAVLYEMLYGLPPFYCRDVAEMYDNILHKPLSLRPGVSLTAWSILEELLEKDRQNRLGAKEDFLEIQNHPFFESLSWADLVQKKIPPPFNPNVAGPDDIRNFDTAFTEETVPYSVCVSSDYSIVNASVLEADDAFVGFSYAPPSEDLFL

SEQ ID NO: 63260 - protein, 496 aa, Homo sapiens; identical to SEQ ID NO: 63259

SEQ ID NO: 63261 - protein, 496 aa, Homo sapiens; identical to SEQ ID NO: 63259

SEQ ID NO: 63262 - protein, 496 aa, Homo sapiens; identical to SEQ ID NO: 63259

SEQ ID NO: 63263 - protein, 464 aa, Homo sapiens
MQRDHTMDYKESCPSVSIPSSDEHREKKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDPSEDEDERSSQKLHSTSQNINLGPSGNPHAKPTDFDFLKVIGKGSFGKVLLAKRKLDGKFYAVKVLQKKIVLNRKEQKHIMAERNVLLKNVKHPFLVGLHYSFQTTEKLYFVLDFVNGGELFFHLQRERSFPEHRARFYAAEIASALGYLHSIKIVYRDLKPENILLDSVGHVVLTDFGLCKEGIAISDTTTTFCGTPEPPFYCRDVAEMYDNILHKPLSLRPGVSLTAWSILEELLEKDRQNRLGAKEDFLEIQNHPFFESLSWADLVQKKIPPPFNPNVAGPDDIRNFDTAFTEETVPYSVCVSSDYSIVNASVLEADDAFVGFSYAPPSEDLFL

SEQ ID NO: 63264 - protein, 496 aa, Homo sapiens; identical to SEQ ID NO: 63259

SEQ ID NO: 63265 - protein, 496 aa, Homo sapiens; identical to SEQ ID NO: 63259

SEQ ID NO: 63266 - protein, 514 aa, Homo sapiens
MVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 63267 - protein, 536 aa, Homo sapiens
MVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKRKNNLHLSTQNKLEASLFSPKKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 63268 - protein, 520 aa, Homo sapiens
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQVRLDPGAGSIFGPTFLPFPGQLSLLVEAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 63269 - protein, 518 aa, Homo sapiens
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQDPKYQGLRARGREIRKELVHLYPREAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 63270 - protein, 278 aa, Homo sapiens
MGARLSRRRLPADPSLALDALPPELLVQVLSHVPPRSLVTRCRPVCRAWRDIVDGPTVWLLQLARDRSAEGRALYAVAQRCLPSNEDKEEFPLCALARYCLRAPFGRNLIFNSCGEQGFRGWEVEHGGNGWAIEKNLTPVPGAPSQTCFVTSFEWCSKRQLVDLVMEGVWQELLDSAQIEICVADWWGARENCGCVYQLRVRLLDVYEKEVVKFSASPDPVLQWTERGCRQVSHVFTNFGKGIRYVSFEQYGRDVSSWVGHYGALVTHSSVRVRIRLS

SEQ ID NO: 63271 - protein, 287 aa, Homo sapiens
FKQGLWLLEMGARLSRRRLPADPSLALDALPPELLVQVLSHVPPRSLVTRCRPVCRAWRDIVDGPTVWLLQLARDRSAEGRALYAVAQRCLPSNEDKEEFPLCALARYCLRAPFGRNLIFNSCGEQGFRGWEVEHGGNGWAIEKNLTPVPGAPSQTCFVTSFEWCSKRQLVDLVMEGVWQELLDSAQIEICVADWWGARENCGCVYQLRVRLLDVYEKEVVKFSASPDPVLQWTERGCRQVSHVFTNFGKGIRYVSFEQYGRDVSSWVGHYGALVTHSSVRVRIRLS

SEQ ID NO: 63272 - protein, 520 aa, Homo sapiens; identical to SEQ ID NO: 63268

SEQ ID NO: 63273 - protein, 518 aa, Homo sapiens
MEGVWQELLDSAQIEICVADWWGARENCGCVYQLRVRLLDVYEKEVVKFSASPDPVLQWTERGCRQVSHVFTNFGKGIRYVSFEQYGRDISTWQELRQLQEQIRSLEEEKAAVTEAVRALLANQDSGEVQQDPKYQGLRARGREIRKELVHLYPREAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 63274 - protein, 236 aa, Homo sapiens
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQDPKYQGLRARGREIRKELVHLYPREAQLEEQFYLQALKLPNQTHPDVPVGDESQARVLHMVGDKPGACPTCLATGPITCAGLEPSCSTAWSTSHSTSFSAGASPP

SEQ ID NO: 63275 - protein, 426 aa, Homo sapiens
MHALFADSFAALGRLDNITLVMVFHPQYLESFLKTQHYLLQMDGPLPLHYRHYIGIMAAARHQCSYLVNLHVNDFLHVGGDPKWLNGLENAPQKLQNLGELNKVLAHRPWLITKEHIEGLLKAEEHSWSLAELVHAVVLLTHYHSLASFTFGCGISPEIHCDGGHTFRPPSVSNYCICDITNGNHSVDEMPVNSAENVSVSDSFFEVEALMEKMRQLQECRDEEEASQEEMASRFEIEKRESMFVFSSDDEEVTPARAVSRHFEDTSYGYKDFSRHGMHVPTFRVQDYCWEDHGYSLVNRLYPDVGQLIDEKFHIAYNLTYNTMAMHKDVDTSMLRRAIWNYIHCMFGIRYDDYDYGEINQLLDRSFKVYIKTVVCTPEKVTKRMYDSFWRQFKHSEKVHVNLLLIEARMQAELLYALRAITRYMT

SEQ ID NO: 63276 - protein, 492 aa, Homo sapiens
MRLAAAANEAYTAPLAVSGLLGCKQCGGGRDQDEELGIRIPRPLGQGPSRFIPEKEILQVGSEDAQMHALFADSFAALGRLDNITLVMVFHPQYLESFLKTQHYLLQMDGPLPLHYRHYIGIMAAARHQCSYLVNLHVNDFLHVGGDPKWLNGLENAPQKLQNLGELNKVLAHRPWLITKEHIEGLLKAEEHSWSLAELVHAVVLLTHYHSLASFTFGCGISPEIHCDGGHTFRPPSVSNYCICDITNGNHSVDEMPVNSAENVSVSDSFFEVEALMEKMRQLQECRDEEEASQEEMASRFEIEKRESMFVFSSDDEEVTPARAVSRHFEDTSYGYKDFSRHGMHVPTFRVQDYCWEDHGYSLVNRLYPDVGQLIDEKFHIAYNLTYNTMAMHKDVDTSMLRRAIWNYIHCMFGIRYDDYDYGEINQLLDRSFKVYIKTVVCTPEKVTKRMYDSFWRQFKHSEKVHVNLLLIEARMQAELLYALRAITRYMT

SEQ ID NO: 63277 - protein, 551 aa, Homo sapiens
MAEGENEVRWDGLCSRDSTTRETALENIRQTILRKTEYLRSVKETPHRPSDGLSNTESSDGLNKLLAHLLMLSKRCPFKDVREKSEFILKSIQELGIRIPRPLGQGPSRFIPEKEILQVGSEDAQMHALFADSFAALGRLDNITLVMVFHPQYLESFLKTQHYLLQMDGPLPLHYRHYIGIMAAARHQCSYLVNLHVNDFLHVGGDPKWLNGLENAPQKLQNLGELNKVLAHRPWLITKEHIEGLLKAEEHSWSLAELVHAVVLLTHYHSLASFTFGCGISPEIHCDGGHTFRPPSVSNYCICDITNGNHSVDEMPVNSAENVSVSDSFFEVEALMEKMRQLQECRDEEEASQEEMASRFEIEKRESMFVFSSDDEEVTPARAVSRHFEDTSYGYKDFSRHGMHVPTFRVQDYCWEDHGYSLVNRLYPDVGQLIDEKFHIAYNLTYNTMAMHKDVDTSMLRRAIWNYIHCMFGIRYDDYDYGEINQLLDRSFKVYIKTVVCTPEKVTKRMYDSFWRQFKHSEKVHVNLLLIEARMQAELLYALRAITRYMT

SEQ ID NO: 63278 - protein, 433 aa, Homo sapiens
MRAEGLGGLERFCSPGKGRGLRALQPFQVGDLLFSCPAYAYVLTVNERGNHCEYCFTRKEGLSKCGRCKQAFYCNVECQKEDWPMHKLECSPMVVFGENWNPSETVRLTARILAKQKIHPERTPSEKLLAVKEFESHLDKLDNEKKDLIQSDIAALHHFYSKHLGFPDNDSLVVLFAQVNCNGFTIEDEELSHLGSAIFPDVALMNHSCCPNVIVTYKGTLAEVRAVQEIKPGEEVFTSYIDLLYPTEDRNDRLRDSYFFTCECQECTTKDKDKAKVEIRKLSDPPKAEAIRDMVRYARNVIEEFRRAKHYKSPSELLEICELSQEKMSSVFEDSNVYMLHMMYQAMGVCLYMQDWEGALQYGQKIIKPYSKHYPLYSLNVASMWLKLGRLYMGLEHKAAGEKALKKAIAIMEVAHGKDHPYISEIKQEIESH

SEQ ID NO: 63279 - protein, 272 aa, Homo sapiens
MRAEGLGGLERFCSPGKGRGLRALQPFQVGDLLFSCPAYAYVLTVNERGNHCEYCFTRKEGLSKCGRCKQAFYCNVECQKEDWPMHKLECSPMVVFGENWNPSETVRLTARILAKQKIHPERTPSEKLLAVKEFESHLDKLDNEKKDLIQSDIAALHHFYSKHLGFPDNDSLVVLFAQVNCNGFTIEDEELSHLGSAIFPDVALMNHSCCPNVIVTYKGTLAEVRAVQEIKPGEEVFTSYIDLLYPTEDRNDRLRDSYFFTCECQECTTKDK

SEQ ID NO: 63280 - protein, 1903 aa, Homo sapiens
MAAGTWAAAAAAAAADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 63281 - protein, 898 aa, Homo sapiens
MAAGTWAAAAAAAAADYFVLVAFGPHPRGSGEGQGQILQRFPEKDWEDNPFPQGIELFCQPSGWQLCPERNPPTFFVAVLTDINSERHYCACLTFWEPAEPSQQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRP

SEQ ID NO: 63282 - protein, 1893 aa, Homo sapiens
MARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 63283 - protein, 1867 aa, Homo sapiens
MARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 63284 - protein, 1849 aa, Homo sapiens
MARLADYFIVVGYDHEKPGSGEGLGKIIQRFPQKDWDDTPFPQGIELFCQPGGWQLSRERKQPTFFVVVLTDIDSDRHYCSCLTFYEAEINLQGTKKEEIEGEAKVSGLIQPAEVFAPKSLVLVSRLYYPEIFRACLGLIYTVYVDSLNVSLESLIANLCACLVPAAGGSQKLFSLGAGDRQLIQTPLHDSLPITGTSVALLFQQLGIQNVLSLFCAVLTENKVLFHSASFQRLSDACRALESLMFPLKYSYPYIPILPAQLLEVLSSPTPFIIGVHSVFKTDVHELLDVIIADLDGGTIKIPECIHLSSLPEPLLHQTQSALSLILHPDLEVADHAFPPPRTALSHSKMLDKEVRAVFLRLFAQLFQGYRSCLQLIRIHAEPVIHFHKTAFLGQRGLVENDFLTKVLSGMAFAGFVSERGPPYRSCDLFDELVAFEVERIKVEENNPVKMIKHVRELAEQLFKNENPNPHMAFQKVPRPTEGSHLRVHILPFPEINEARVQELIQENVAKNQNAPPATRIEKKCVVPAGPPVVSIMDKVTTVFNSAQRLEVVRNCISFIFENKILETEKTLPAALRALKGKAARQCLTDELGLHVQQNRAILDHQQFDYIIRMMNCTLQDCSSLEEYNIAAALLPLTSAFYRKLAPGVSQFAYTCVQDHPIWTNQQFWETTFYNAVQEQVRSLYLSAKEDNHAPHLKQKDKLPDDHYQEKTAMDLAAEQLRLWPTLSKSTQQELVQHEESTVFSQAIHFANLMVNLLVPLDTSKNKLLRTSAPGDWESGSNSIVTNSIAGSVAESYDTESGFEDSENTDIANSVVRFITRFIDKVCTESGVTQDHIKSLHCMIPGIVAMHIETLEAVHRESRRLPPIQKPKILRPALLPGEEIVCEGLRVLLDPDGREEATGGLLGGPQLLPAEGALFLTTYRILFRGTPHDQLVGEQTVVRSFPIASITKEKKITMQNQLQQNMQEGLQITSASFQLIKVAFDEEVSPEVVEIFKKQLMKFRYPQSIFSTFAFAAGQTTPQIILPKQKEKNTSFRTFSKTIVKGAKRAGKMTIGRQYLLKKKTGTIVEERVNRPGWNEDDDVSVSDESELPTSTTLKASEKSTMEQLVEKACFRDYQRLGLGTISGSSSRSRPEYFRITASNRMYSLCRSYPGLLVVPQAVQDSSLPRVARCYRHNRLPVVCWKNSRSGTLLLRSGGFHGKGVVGLFKSQNSPQAAPTSSLESSSSIEQEKYLQALLNAVSVHQKLRGNSTLTVRPAFALSPGVWASLRSSTRLISSPTSFIDVGARLAGKDHSASFSNSSYLQNQLLKRQAALYIFGEKSQLRNFKVEFALNCEFVPVEFHEIRQVKASFKKLMRACIPSTIPTDSEVTFLKALGDSEWFPQLHRIMQLAVVVSEVLENGSSVLVCLEEGWDITAQVTSLVQLLSDPFYRTLEGFQMLVEKEWLSFGHKFSQRSSLTLNCQGSGFAPVFLQFLDCVHQVHNQYPTEFEFNLYYLKFLAFHYVSNRFKTFLLDSDYERLEHGTLFDDKGEKHAKKGVCIWECIDRMHKRSPIFFNYLYSPLEIEALKPNVNVSSLKKWDYYIEETLSTGPSYDWMMLTPKHFPSEDSDLAGEAGPRSQRRTVWPCYDDVSCTQPDALTSLFSEIEKLEHKLNQAPEKWQQLWERVTVDLKEEPRTDRSQRHLSRSPGIVSTNLPSYQKRSLLHLPDSSMGEEQNSSISPSNGVERRAATLYSQYTSKNDENRSFEGTLYKRGALLKGWKPRWFVLDVTKHQLRYYDSGEDTSCKGHIDLAEVEMVIPAGPSMGAPKHTSDKAFFDLKTSKRVYNFCAQDGQSAQQWMDKIQSCISDA

SEQ ID NO: 63285 - protein, 1596 aa, Homo sapiens
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSGDQKVSRAGKNSKATKEEERSHSKKKLLTASDLAASDLKGFQPQAYERPQKHSTLHYDTGLPQDFTGDTLKPKHQQKSSSQNHMDWSTNSDSGPVTQNCFISPESGRETASTSKIPALEPVASFAKAQGKKGSAGNTWSQLSNNNKDLLLGGVAPSPSSHSSPAPPSSSAECNGLQPLVDQDGGGTKEPPEPPTVGSKKKSSKKDVISQTIPNPDLDWVKNAQKAFDNTEGKREGYSADSAQEASPARQNVSSASNPENDSSHVRITIPIKAPSLDPTNHKRKKRQSIKAVVEKIMPEKALASGITMSSEVVNRILSNSEGNKKDPRVPKLSKMIENESPSVGLETGGNAEKVIPGGVSKPRKPPMVMTPPTCTDHSPSRKLPEIQHPKFAAKRRWTCSKPKPSTMLREAVMATSDKLMLEPPSAYPITPSSPLYTNTDSLTVITPVKKKRGRPKKQPLLTVETIHEGTSTSPVSPISREFPGTKKRKRRRNLAKLAQLVPGEDKPMSEMKFHKKVGKLGVLDKKTIKTINKMKTLKRKNILNQILSCSSSVALKAKAPPETSPGAAAIESKLGKQINVSKRGTIYIGKKRGRKPRAELPPPSEEPKTAIKHPRPVSSQPDVPAVPSNFQSLVASSPAAMHPLSTQLGGSNGNLSPASTETNFSELKTMPNLQPISALPTKTQKGIHSGTWKLSPPRLMANSPSHLCEIGSLKEITLSPVSESHSEETIPSDSGIGTDNNSTSDQAEKSSESRRRYSFDFCSLDNPEAIPSDTSTKNRHGHRQKHLIVDNFLAHESLKKPKHKRKRKSLQNRDDLQFLADLEELITKFQVFRISHRSYTFYHENPYPSIFRINFDHYYPVPYIQYDPLLYLRRTSDLKSKKKRGRPAKTNDTMTKVPFLQGFSYPIPSGSYYAPYGMPYTSMPMMNLGYYGQYPAPLYLSHTLGAASPFMRPTVPPPQFHTNSHVKMSGAAKHKAKHGVHLQGPVSMGLGDMQPSLNPPKVGSASLSSGRLHKRKHKHKHKHKEDRILGTHDNLSGLFAGKATGFSSHILSERLSSADKELPLVSEKNKHKEKQKHQHSEAGHKASKNNFEVDTLSTLSLSDAQHWTQAKEKGDLSSEPVDSCTKRYSGSGGDGGSTRSENLDVFSEMNPSNDKWDSDVSGSKRRSYEGFGTYREKDIQAFKMNRKERSSYDSSMSPGMPSPHLKVDQTAVHSKNEGSVPTMMTRKKPAAVDSVTIPPAPVLSLLAASAATSDAVGSSLKKRFKRREIEAIQCEVRKMCNYTKILSTKKNLDHVNKILKAKRLQRQSKTGNNFVKKRRGRPRKQPTQFDEDSRDQMPVLEKCIDLPSKRGQKPSLSPLVLEPAASQDTIMATIEAVIHMAREAPPLPPPPPPPLPPPPPPPLPPPPPLPKTPRGGKRKHKPQAPAQPPQQSPPQQPLPQEEEVKAKRQRKSRGSESEVLP

SEQ ID NO: 63286 - protein, 242 aa, Homo sapiens
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSGDQKVSRAGKNSKATKEEERSHSKKKLLTASDLAASDLKGFQPQIKDSSKEEVWKRRGGQGIPFKKQFLSQERAMCFSCPRNPFPAKPGSLTLPFHSEPAVWAQEV

SEQ ID NO: 63287 - protein, 137 aa, Homo sapiens
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSG

SEQ ID NO: 63288 - protein, 684 aa, Homo sapiens
MFAEAAKTTRPCGMAEFKEKPEAPTEQLDVACGQENLPVGAWPPGAAPAPFQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGRFVCEYAGEVLGFSEVQRRIHLQTKSDSNYIIAIREHVYNGQVMETFVDPTYIGNIGRFLNHSCEPNLLMIPVRIDSMVPKLALFAAKDIVPEEELSYDYSGRYLNLTVSEDKERLDHGKLRKPCYCGAKSCTAFLPFDSSLYCPVEKSNISCGNEKEPSMCGSAPSVFPSCKRLTLETMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNEPFLDRIVTCDEKWILYDNRRRSAQWLDQEEAPKHFPKPILHPKKVMVTIWWSAAGLIHYSFLNPGETITSEKYAQEIDEMNQKLQRLQLALVNRKGPILLHDNARPHVAQPTLQKLNELGYEVLPHPPYSPDLLPTNYHVFKHLNNFLQGKRFHNQQDAENAFQEFVESQSTDFYATGINQLISRWQKCVDCNGSYFD

SEQ ID NO: 63289 - protein, 365 aa, Homo sapiens
MFAEAAKTTRPCGMAEFKEKPEAPTEQLDVACGQENLPVGAWPPGAAPAPFQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGRFVCEYAGEVLGFSEVQRRIHLQTKSDSNYIIAIREHVYNGQVMETFVDPTYIGNIGRFLNHSCEPNLLMIPVRIDSMVPKLALFAAKDIVPEEELSYDYSGRYLNLTVSEDKERLDHGKLRKPCYCGAKSCTAFLPFDSSLYCPVEKSNISCGNEKEPSMCGSAPSVFPSCKRLTLEVSLFSDKQLAPPYSGRQWLASFTSA

SEQ ID NO: 63290 - protein, 171 aa, Homo sapiens
MFAEAAKTTRPCGMAEFKEKPEAPTEQLDVACGQENLPVGAWPPGAAPAPFQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGRKVEHQLWK

SEQ ID NO: 63291 - protein, 366 aa, Homo sapiens
MDSDDEMVEEAVEGHLDDDGLPHGFCTVTYSSTDRFEGNFVHGEKNGRGKFFFFDGSTLEGYYVDDALQGQGVYTYEDGGVLQGTYVDGELNGPAQEYDTDGRLIFKGQYKDNIRHGVCWIYYPDGGSLVGEVNEDGEMTGEKIAYVYPDERTALYGKFIDGEMIEGKLATLMSTEEGRPHFELMPGNSVYHFDKSTSSCISTNALLPDPYESERVYVAESLISSAGEGLFSKVAVGPNTVMSFYNGVRITHQEVDSRDWALNGNTLSLDEETVIDVPEPYNHVSKYCASLGHKANHSFTPNCIYDMFVHPRFGPIKCIRTLRAVEADEELTVAYGYDHSPPGKSGPEAPEWYQVELKAFQATQQK

SEQ ID NO: 63292 - protein, 1707 aa, Homo sapiens
MDQEGGGDGQKAPSFQWRNYKLIVDPALDPALRRPSQKVYRYDGVHFSVNDSKYIPVEDLQDPRCHVRSKNRDFSLPVPKFKLDEFYIGQIPLKEVTFARLNDNVRETFLKDMCRKYGEVEEVEILLHPRTRKHLGLARVLFTSTRGAKETVKNLHLTSVMGNIIHAQLDIKGQQRMKYYELIVNGSYTPQTVPTGGKALSEKFQGSGAATETAESRRRSSSDTAAYPAGTTAVGTPGNGTPCSQDTSFSSSRQDTPSSFGQFTPQSSQGTPYTSRGSTPYSQDSAYSSSTTSTSFKPRRSENSYQDAFSRRHFSASSASTTASTAIAATTAATASSSASSSSLSSSSSSSSSSSSSQFRSSDANYPAYYESWNRYQRHTSYPPRRATREEPPGAPFAENTAERFPPSYTSYLPPEPSRPTDQDYRPPASEAPPPEPPEPGGGGGGGGPSPEREEVRTSPRPASPARSGSPAPETTNESVPFAQHSSLDSRIEMLLKEQRSKFSFLASDTEEEEENSSMVLGARDTGSEVPSGSGHGPCTPPPAPANFEDVAPTGSGEPGATRESPKANGQNQASPCSSGDDMEISDDDRGGSPPPAPTPPQQPPPPPPPPPPPPPYLASLPLGYPPHQPAYLLPPRPDGPPPPEYPPPPPPPPHIYDFVNSLELMDRLGAQWGGMPMSFQMQTQMLTRLHQLRQGKGLIAASAGPPGGAFGEAFLPFPPPQEAAYGLPYALYAQGQEGRGAYSREAYHLPMPMAAEPLPSSSVSGEEARLPPREEAELAEGKTLPTAGTVGRVLAMLVQEMKSIMQRDLNRKMVENVAFGAFDQWWESKEEKAKPFQNAAKQQAKEEDKEKTKLKEPGLLSLVDWAKSGGTTGIEAFAFGSGLRGALRLPSFKVKRKEPSEISEASEEKRPRPSTPAEEDEDDPEQEKEAGEPGRPGTKPPKRDEERGKTQGKHRKSFALDSEGEEASQESSSEKDEEDDEEDEEDEDREEAVDTTKKETEVSDGEDEESDSSSKCSLYADSDGENDSTSDSESSSSSSSSSSSSSSSSSSSSSSSSESSSEDEEEEERPAALPSASPPPREVPVPTPAPVEVPVPERVAGSPVTPLPEQEASPARPAGPTEESPPSAPLRPPEPPAGPPAPAPRPDERPSSPIPLLPPPKKRRKTVSFSAIEVVPAPEPPPATPPQAKFPGPASRKAPRGVERTIRNLPLDHASLVKSWPEEVSRGGRSRAGGRGRLTEEEEAEPGTEVDLAVLADLALTPARRGLPALPAVEDSEATETSDEAERPRPLLSHILLEHNYALAVKPTPPAPALRPPEPVPAPAALFSSPADEVLEAPEVVVAEAEEPKPQQLQQQREEGEEEGEEEGEEEEEESSDSSSSSDGEGALRRRSLRSHARRRRPPPPPPPPPPRAYEPRSEFEQMTILYDIWNSGLDSEDMSYLRLTYERLLQQTSGADWLNDTHWVHHTITNLTTPKRKRRPQDGPREHQTGSARSEGYYPISKKEKDKYLDVCPVSARQLEGVDTQGTNRVLSERRSEQRRLLSAIGTSAIMDSDLLKLNQLKFRKKKLRFGRSRIHEWGLFAMEPIAADEMVIEYVGQNIRQMVADMREKRYVQEGIGSSYLFRVDHDTIIDATKCGNLARFINHCCTPNCYAKVITIESQKKIVIYSKQPIGVDEEITYDYKFPLEDNKIPCLCGTESCRGSLN

SEQ ID NO: 63293 - protein, 70 aa, Homo sapiens
MDQEGGGDGQKAPSFQWRNYKLIVDPALDPALRRPSQKVYRYDGVHFSVNDSKYIPVEDLQDPRCHVRSK

SEQ ID NO: 63294 - protein, 247 aa, Homo sapiens
MDQEGGGDGQKAPSFQWRNYKLIVDPALDPALRRPSQKVYRYDGVHFSVNDSKYIPVEDLQDPRCHVRSKNRDFSLPVPKFKLDEFYIGQIPLKEVTFARLNDNVRETFLKDMCRKYGEVEEVEILLHPRTRKHLGLARVLFTSTRGAKETVKNLHLTSVMGNIIHAQLDIKGQQRMKYYELIVNGSYTPQTVPTGGKALSEKFQGSGAATETAESRRRSSSDTAAYPAGTTAVGTPGNGTPCSQDT

SEQ ID NO: 63295 - protein, 1923 aa, Homo sapiens
MENSHPPHHHHQQPPPQPGPSGERRNHHWRSYKLMIDPALKKGHHKLYRYDGQHFSLAMSSNRPVEIVEDPRVVGIWTKNKELELSVPKFKIDEFYVGPVPPKQVTFAKLNDNIRENFLRDMCKKYGEVEEVEILYNPKTKKHLGIAKVVFATVRGAKDAVQHLHSTSVMGNIIHVELDTKGETRMRFYELLVTGRYTPQTLPVGELDAVSPIVNETLQLSDALKRLKDGGLSAGCGSGSSSVTPNSGGTPFSQDTAYSSCRLDTPNSYGQGTPLTPRLGTPFSQDSSYSSRQPTPSYLFSQDPAVTFKARRHESKFTDAYNRRHEHHYVHNSPAVTAVAGATAAFRGSSDLPFGAVGGTGGSSGPPFKAQPQDSATFAHTPPPAQATPAPGFKSAFSPYQTPVAHFPPPPEEPTATAAFGARDSGEFRRAPAPPPLPPAEPLAKEKPGTPPGPPPPDTNSMELGGRPTFGWSPEPCDSPGTPTLESSPAGPEKPHDSLDSRIEMLLKEQRTKLLFLREPDSDTELQMEGSPISSSSSQLSPLAPFGTNSQPGFRGPTPPSSRPSSTGLEDISPTPLPDSDEDEELDLGLGPRPPPEPGPPDPAGLLSQTAEVALDLVGDRTPTSEKMDEGQQSSGEDMEISDDEMPSAPITSADCPKPMVVTPGAAAVAAPSVLAPTLPLPPPPGFPPLPPPPPPPPPQPGFPMPPPLPPPPPPPPPAHPAVTVPPPPLPAPPGVPPPPILPPLPPFPPGLFPVMQVDMSHVLGGQWGGMPMSFQMQTQVLSRLMTGQGACPYPPFMAAAAAAASAGLQFVNLPPYRGPFSLSNSGPGRGQHWPPLPKFDPSVPPPGYMPRQEDPHKATVDGVLLVVLKELKAIMKRDLNRKMVEVVAFRAFDEWWDKKERMAKASLTPVKSGEHKDEDRPKPKDRIASCLLESWGKGEGLGYEGLGLGIGLRGAIRLPSFKVKRKEPPDTTSSGDQKRLRPSTSVDEEDEESERERDRDMADTPCELAKRDPKGVGVRRRPARPLELDSGGEEDEKESLSEEQESTEEEEEAEEEEEEEDDDDDDSDDRDESENDDEDTALSEASEKDEGDSDEEETVSIVTSKAEATSSSESSESSEFESSSESSPSSSEDEEEVVAREEEEEEEEEEMVAEESMASAGPEDFEQDGEEAALAPGAPAVDSLGMEEEVDIETEAVAPEERPSMLDEPPLPVGVEEPADSREPPEEPGLSQEGAMLLSPEPPAKEVEARPPLSPERAPEHDLEVEPEPPMMLPLPLQPPLPPPRPPRPPSPPPEPETTDASHPSVPPEPLAEDHPPHTPGLCGSLAKSQSTETVPATPGGEPPLSGGSSGLSLSSPQVPGSPFSYPAPSPSLSSGGLPRTPGRDFSFTPTFSEPSGPLLLPVCPLPTGRRDERSGPLASPVLLETGLPLPLPLPLPLPLALPAVLRAQARAPTPLPPLLPAPLASCPPPMKRKPGRPRRSPPSMLSLDGPLVRPPAGAALGRELLLLPGQPQTPVFPSTHDPRTVTLDFRNAGIPAPPPPLPPQPPPPPPPPPVEPTKLPFKELDNQWPSEAIPPGPRGRDEVTEEYMELAKSRGPWRRPPKKRHEDLVPPAGSPELSPPQPLFRPRSEFEEMTILYDIWNGGIDEEDIRFLCVTYERLLQQDNGMDWLNDTLWVYHPSTSLSSAKKKKRDDGIREHVTGCARSEGFYTIDKKDKLRYLNSSRASTDEPPADTQGMSIPAQPHASTRAGSERRSEQRRLLSSFTGSCDSDLLKFNQLKFRKKKLKFCKSHIHDWGLFAMEPIAADEMVIEYVGQNIRQVIADMREKRYEDEGIGSSYMFRVDHDTIIDATKCGNFARFINHSCNPNCYAKVITVESQKKIVIYSKQHINVNEEITYDYKFPIEDVKIPCLCGSENCRGTLN

SEQ ID NO: 63296 - protein, 1923 aa, Homo sapiens; identical to SEQ ID NO: 63295

SEQ ID NO: 63297 - protein, 2564 aa, Homo sapiens
MKQLQPQPPPKMGDFYDPEHPTPEEEENEAKIENVQKTGFIKGPMFKGVASSRFLPKGTKTKVNLEEQGRQKVSFSFSLTKKTLQNRFLTALGNEKQSDTPNPPAVPLQVDSTPKMKMEIGDTLSTAEESSPPKSRVELGKIHFKKHLLHVTSRPLLATTTAVASPPTHAAPLPAVIAESTTVDSPPSSPPPPPPPAQATTLSSPAPVTEPVALPHTPITVLMAAPVPLPVDVAVRSLKEPPIIIVPESLEADTKQDTISNSLEEHVTQILNEQADISSKKEDSHIGKDEEIPDSSKISLSCKKTGSKKKSSQSEGIFLGSESDEDSVRTSSSQRSHDLKFSASIEKERDFKKSSAPLKSEDLGKPSRSKTDRDDKYFSYSKLERDTRYVSSRCRSERERRRSRSHSRSERGSRTNLSYSRSERSHYYDSDRRYHRSSPYRERTRYSRPYTDNRARESSDSEEEYKKTYSRRTSSHSSSYRDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVLSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTTTERGRDAVGFRDQTPAPKTPNRSRERDPDKQTQNKEKRKRRSSLSPPSSAYERGTKRPDDRYDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAEMDLGTPTYDENPMKASKKPKTAEADTSSELAKKSKEVFRKEMSQFIVQCLNPYRKPDCKVGRITTTEDFKHLARKLTHGVMNKELKYCKNPEDLECNENVKHKTKEYIKKYMQKFGAVYKPKEDTELE

SEQ ID NO: 63298 - protein, 2564 aa, Homo sapiens
MKQLQPQPPPKMGDFYDPEHPTPEEQEPEAKIENVQKTGFIKGPMFKGVASSRFLPKGTKTKVNLEEQGRQKVSFSFSLTKKTLQNRFLTALGNEKQSDTPNPPAVPLQVDSTPKMKMEIGDTLSTAEESSPPKSRVELGKIHFKKHLLHVTSRPLLATTTAVASPPTHAAPLPAVIAESTTVDSPPSSPPPPPPPAQATTLSSPAPVTEPVALPHTPITVLMAAPVPLPVDVAVRSLKEPPIIIVPESLEADTKQDTISNSLEEHVTQILNEQADISSKKEDSHIGKDEEIPDSSKISLSCKKTGSKKKSSQSEGIFLGSESDEDSVRTSSSQRSHDLKFSASIEKERDFKKSSAPLKSEDLGKPSRSKTDRDDKYFSYSKLERDTRYVSSRCRSERERRRSRSHSRSERGSRTNLSYSRSERSHYYDSDRRYHRSSPYRERTRYSRPYTDNRARESSDSEEEYKKTYSRRTSSHSSSYRDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVLSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTTTERGRDAVGFRDQTPAPKTPNRSRERDPDKQTQNKEKRKRRSSLSPPSSAYERGTKRPDDRYDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAEMDLGTPTYDENPMKASKKPKTAEADTSSELAKKSKEVFRKEMSQFIVQCLNPYRKPDCKVGRITTTEDFKHLARKLTHGVMNKELKYCKNPEDLECNENVKHKTKEYIKKYMQKFGAVYKPKEDTELE

SEQ ID NO: 63299 - protein, 1714 aa, Homo sapiens
MKQLQPQPPPKMGDFYDPEHPTPEKKEREAKIENVQKTGFIKGPMFKGVASSRFLPKGTKTKVNLEEQGRQKVSFSFSLTKKTLQNRFLTALGNEKQSDTPNPPAVPLQVDSTPKMKMEIGDTLSTAEESSPPKSRVELGKIHFKKHLLHVTSRPLLATTTAVASPPTHAAPLPAVIAESTTVDSPPSSPPPPPPPAQATTLSSPAPVTEPVALPHTPITVLMAAPVPLPVDVAVRSLKEPPIIIVPESLEADTKQDTISNSLEEHVTQILNEQADISSKKEDSHIGKDEEIPDSSKISLSCKKTGSKKKSSQSEGIFLGSESDEDSVRTSSSQRSHDLKFSASIEKERDFKKSSAPLKSEDLGKPSRSKTDRDDKYFSYSKLERDTRYVSSRCRSERERRRSRSHSRSERGSRTNLSYSRSERSHYYDSDRRYHRSSPYRERTRYSRPYTDNRARESSDSEEEYKKTYSRRTSSHSSSYRDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDS

SEQ ID NO: 63300 - protein, 1291 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNHSCSPNLFVQNVFVDTHDLRFPWVAFFASKRIRAGTELTWDYNYEVGSVEGKELLCCCGAIECRGRLL

SEQ ID NO: 63301 - protein, 397 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLVLFFSTILEAEVGGGGT

SEQ ID NO: 63302 - protein, 249 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGFSFSLMMAMLPMSHSRNCIPFAGH

SEQ ID NO: 63303 - protein, 1290 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNHSCSPNLFVQNVFVDTHDLRFPWVAFFASKIRAGTELTWDYNYEVGSVEGKELLCCCGAIECRGRLL

SEQ ID NO: 63304 - protein, 167 aa, Homo sapiens
MSSLPGCIGLDAATATVESEEIAELQQAVVEELGISMEELRHFIDEELEKMDCVQQRKKQLAELETVGPGKKYKVKFDNKGKSLLSGNHIAYDYHPPADKLYVGSRVVAKYKDGNQVWLYAGIVAETPNVKNKLRFLIFFDDGYASYVTQSELYPICRPRECFSLIP

SEQ ID NO: 63305 - protein, 156 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAA

SEQ ID NO: 63306 - protein, 1259 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNVRPLSPPLDAGLSHGPQISFNILYKPFSCYKLLISK

SEQ ID NO: 63307 - protein, 163 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQD

SEQ ID NO: 63308 - protein, 636 aa, Homo sapiens
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSESLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCL

SEQ ID NO: 63309 - protein, 719 aa, Homo sapiens
MGEKNGDAKTFWMELEDDGKVDFIFEQVQNVLQSLKQKIKDGSATNKEYIQAMILVNEATIINSSTSIKGASQKEVNAQSSDPMPVTQKEQENKSNAFPSTSCENSFPEDCTFLTTENKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTVETKYDNISRIQYHSVIRDPESKTAIFQHNGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNHSCCPNLLVQNVFVETHNRNFPLVAFFTNRYVKARTELTWDYGYEAGTVPEKEIFCQCGVNKCRKKIL

SEQ ID NO: 63310 - protein, 707 aa, Homo sapiens
MGEKNGDAKTFWMELEDDGKVDFIFEQVQNVLQSLKQKIKDGSATNKEYIQAMILVNEATIINSSTSIKDPMPVTQKEQENKSNAFPSTSCENSFPEDCTFLTTENKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTVETKYDNISRIQYHSVIRDPESKTAIFQHNGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNHSCCPNLLVQNVFVETHNRNFPLVAFFTNRYVKARTELTWDYGYEAGTVPEKEIFCQCGVNKCRKKIL

SEQ ID NO: 63311 - protein, 324 aa, Homo sapiens
MSRPSSTGPSANKPCSKQPPPQPQHTPSPAAPPAAATISAAGPGSSAVPAAAAVISGPGGGGGAGPVSPQHHELTSLFECPVCFDYVLPPILQCQAGHLVCNQCRQKLSCCPTCRGALTPSIRNLAMEKVASAVLFPCKYATTGCSLTLHHTEKPEHEDICEYRPYSCPCPGASCKWQGSLEAVMSHLMHAHKSITTLQGEDIVFLATDINLPGAVDWVMMQSCFGHHFMLVLEKQEKYEGHQQFFAIVLLIGTRKQAENFAYRLELNGNRRRLTWEATPRSIHDGVAAAIMNSDCLVFDTAIAHLFADNGNLGINVTISTCCP

SEQ ID NO: 63312 - protein, 329 aa, Homo sapiens
MMSNSSSEIDVIKTRIPTYDEDDNTILYAYETKPEFVNKEPNIVSDASCNTEEQLKTVDDVLIHCQVIYDALQNLDKKIDVIRRKVSKIQRFHARSLWTNHKRYGYKKHSYRLVKKLKLQKMKKNEVYETFSYPESYSPTLPVSRRENNSPSNLPRPSFCMEEYQRAELEEDPILSRTPSPVHPSDFSEHNCQPYYASDGATYGSSSGLCLGNPRADSIHNTYSTDHASAAPPSVTRSPVENDGYIEEGSITKHPSTWSVEAVVLFLKQTDPLALCPLVDLFRSHEIDGKALLLLTSDVLLKHLGVKLGTAVKLCYYIDRLKQGKCFEN

SEQ ID NO: 63313 - protein, 302 aa, Homo sapiens
MMSNSSSEIDVQEPNIVSDASCNTEEQLKTVDDVLIHCQVIYDALQNLDKKIDVIRRKVSKIQRFHARSLWTNHKRYGYKKHSYRLVKKLKLQKMKKNEVYETFSYPESYSPTLPVSRRENNSPSNLPRPSFCMEEYQRAELEEDPILSRTPSPVHPSDFSEHNCQPYYASDGATYGSSSGLCLGNPRADSIHNTYSTDHASAAPPSVTRSPVENDGYIEEGSITKHPSTWSVEAVVLFLKQTDPLALCPLVDLFRSHEIDGKALLLLTSDVLLKHLGVKLGTAVKLCYYIDRLKQGKCFEN

SEQ ID NO: 63314 - protein, 208 aa, Homo sapiens
MKKNEVYETFSYPESYSPTLPVSRRENNSPSNLPRPSFCMEEYQRAELEEDPILSRTPSPVHPSDFSEHNCQPYYASDGATYGSSSGLCLGNPRADSIHNTYSTDHASAAPPSVTRSPVENDGYIEEGSITKHPSTWSVEAVVLFLKQTDPLALCPLVDLFRSHEIDGKALLLLTSDVLLKHLGVKLGTAVKLCYYIDRLKQGKCFEN

SEQ ID NO: 63315 - protein, 208 aa, Homo sapiens; identical to SEQ ID NO: 63314

SEQ ID NO: 63316 - protein, 148 aa, Homo sapiens
MMSNSSSEIDVQEPNIVSDASCNTEEQLKTVDDVLIHCQVIYDALQNLDKKIDVIRRKVSKIQRFHARSLWTNHKRYGYKKHSYRLVKKLKLQKMKKNEVYETFSYPESYSPTLPVSRRENNSPSNLPRPSFCMEEYQRAELEEDPIL

SEQ ID NO: 63317 - protein, 700 aa, Homo sapiens
MGQTVNEDSMDVKKENQEKTPQSSTSSVQRDDFHWEEYLKETGSISAPSECFRQSQIPPVNDFKVGMKLEARDPRNATSVCIATVIGITGARLRLRLDGSDNRNDFWRLVDSPDIQPVGTCEKEGDLLQPPLGYQMNTSSWPMFLLKTLNGSEMASATLFKKEPPKPPLNNFKVGMKLEAIDKKNPYLICPATIGDVKGDEVHITFDGWSGAFDYWCKYDSRDIFPAGWCRLTGDVLQPPGTSVPIVKNIAKTESSPSEASQHSMQSPQKTTLILPTQQVRRSSRIKPPGPTAVPKRSSSVKNITPRKKGPNSGKKEKPLPVICSTSAASLKSLTRDRGMLYKDVASGPCKIVMSTVCVYVNKHGNFGPHLDPKRIQQLPDHFGPGPVNVVLRRIVQACVDCALETKTVFGYLKPDNRGGEVITASFDGETHSIQLPPVNSASFALRFLENFCHSLQCDNLLSSQPFSSSRGHTHSSAEHDKNQSAKEDVTERQSTKRSPQQTVPYVVPLSPKLPKTKEYASEGEPLFAGGSAIPKEENLSEDSKSSSLNSGNYLNPACRNPMYIHTSVSQDFSRSVPGTTSSPLVGDISPKSSPHEVKFQMQRKSEAPSYIAVPDPSVLKQGFSKDPSTWSVDEVIQFMKHTDPQISGPLADLFRQHEIDGKALFLLKSDVMMKYMGLKLGPALKLCYYIEKLKEGKYS

SEQ ID NO: 63318 - protein, 345 aa, Homo sapiens
MQSPQKTTLILPTQQVRRSSRIKPPGPTAVPKRSSSVKNITPRKKGPNSGKKEKPLPVICSTSAASLKSLTRDRGMLYKDVASGPCKIVMSTVCVYVNKHGNFGPHLDPKRIQQLPDHFGPGPVNVVLRRIVQACVDCALETKTVFGYLKPDNRGGEVITASFDGETHSIQLPPVNSASFALRFLENFCHSLQCDNLLSSQPFSSSRGHTHSSAEHDKNQSAKEDVTERQSTKRSPQQTVPYVVPLSPKLPKTKEYASEGEPLFAGGSAIPKEENLSEDSKSSSLNSGNYLNPACRNPMYIHTSVSQDFSRSVPGTTSSPLVGDISPKSSPHEVKFQMQRKSEGN

SEQ ID NO: 63319 - protein, 125 aa, Homo sapiens
  MOD_RES (1)..(1): Any amino acid
XAKEDVTERQSTKRSPQQTVPYVVPLSPKLPKTKEYASEGEPLFAGGSAIPKEENLSEDSKSSSLNSGNYLNPACRNPMYIHTSVSQDFSRSVPGTTSSPLVGDISPKSSPHEVKFQMQRKSEGN

SEQ ID NO: 63320 - protein, 577 aa, Homo sapiens
MGQTVNEDSMDVKKENQEKTPQSQIPPVNDFKVGMKLEARDPRNATSVCIATVIGITGARLRLRLDGSDNRNDFWRLVDSPDIQPVGTCEKEGDLLQPPLGYQMNTSSWPMFLLKTLNGSEMASATLFKKEPPKPPLNNFKVGMKLEAIDKKNPYLICPATIGDVKGDEVHITFDGWSGAFDYWCKYDSRDIFPAGWCRLTGDVLQPPGTSVPIVKNIAKTESSPSEASQHSMQSPQKTTLILPTQQVRRSSRIKPPGPTAVPKRSSSVKNITPRKKGPNSGKKEKPLPVICSTSAASLKSLTRDRGMLYKDVASGPCKIVMSTVCVYVNKHGNFGPHLDPKRIQQLPDHFGPGPVNVVLRRIVQACVDCALETKTVFGYLKPDNRGGEVITASFDGETHSIQLPPVNSASFALRFLENFCHSLQCDNLLSSQPFSSSRGHTHSSAEHDKNQSAKEDVTERQSTKRSPQQTVPYVVPLSPKLPKTKEYASEGEPLFAGGSAIPKEENLSEDSKSSSLNSGNYLNPACRNPMYIHTSVSQDFSRSVPGTTSSPLVGDISPKSSPHEVKFQMQRKSEGN

SEQ ID NO: 63321 - protein, 204 aa, Homo sapiens
MQSYASAMLSVFNSDDYSPAVQENIPALRRSSSFLCTESCNSKYQCETGENSKGNVQDRVKRPMNAFIVWSRDQRRKMALENPRMRNSEISKQLGYQWKMLTEAEKWPFFQEAQKLQAMHREKYPNYKYRPRRKAKMLPKNCSLLPADPASVLCSEVQLDNRLYRDDCTKATHSRMEHQLGHLPPINAASSPQQRDRYSHWTKL

SEQ ID NO: 63322 - protein, 197 aa, Homo sapiens
MQSYASAMLSVFNSDDYSPAVQENIPALRRSSSFLCTESCNSKYQCETGENSKGNVQDRVKRPMNAFIVWSRDQRRKMALENPRMRNSEISKQLGYQWKMLTEAEKWPFFQEAQKLQAMHREKYPNYKYRPRRKAKMLPKNCSLLPADPASVLCSEVQLDNRLYRDDCTKATHSRMEHQLGHLPPINAASAATGPLQ

SEQ ID NO: 63323 - protein, 165 aa, Homo sapiens
MQSYASAMLSVFNSDDYSPAVQENIPALRRSSSFLCTESCNSKYQCETGENSKGNVQDRVKRPMNAFIVWSRDQRRKMALENPRMRNSEISKQLGYQWKMLTEAEKWPFFQEAQKLQAMHREKYPNYKYRPRRKAKMLPKNCSLLPADPASVLCSEVQGQQVVQG

SEQ ID NO: 63324 - protein, 1242 aa, Homo sapiens
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 63325 - protein, 1160 aa, Homo sapiens
MKNLLTEKCISSHNFHQKVIKQRMEKKVDSRFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 63326 - protein, 1031 aa, Homo sapiens
MKNLLTEKCISSHNFHQKVIKQRMEKKVDSRFYYEQRLLRKVFEEWKEEWWVFQHEWKLCVRADCHYRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAAWTLRLNLRRSSSNYCTTRPPSRTSGPVGGKRAACAGGWS

SEQ ID NO: 63327 - protein, 991 aa, Homo sapiens
MKNLLTEKCISSHNFHQKVIKQRMEKKVDSRYFKDGAVKKPYSAKTLSNKKSSASFGIRRELPSTSHLVQYRGTHTCTRQGRLRELRIRFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 63328 - protein, 1211 aa, Homo sapiens
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 63329 - protein, 1160 aa, Homo sapiens; identical to SEQ ID NO: 63325

SEQ ID NO: 63330 - protein, 79 aa, Homo sapiens
MKNLLTEKCISSHNFHQKVIKQRMEKKVDSRYFKDGAVKKPYSAKTLSNKKSSASFGIRRELPSTSHLVQYRGTHTCTR

SEQ ID NO: 63331 - protein, 1187 aa, Homo sapiens
MKNLLTEKCISSHNFHQKVIKQRMEKKVDSRYFKDGAVKKPYSAKTLSNKKSSASFGIRRELPSTSHLVQYRGTHTCTRQGRLRELRIRFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 63332 - protein, 125 aa, Homo sapiens
MDAVAVYHGKISRETGEKLLLATGLDGSYLLRDSESVPGVYCLCVLYHGYIYTYRVSQTETGSWSAETAPGVHKRYFRKIKNLISAFQKPDQGIVIPLQYPVEKKSSARSTQGIREDPDVCLKAP

SEQ ID NO: 63333 - protein, 128 aa, Homo sapiens
MDAVAVYHGKISRETGEKLLLATGLDGSYLLRDSESVPGVYCLCVLYHGYIYTYRVSQTETGSWSAETAPGVHKRYFRKIKNLISAFQKPDQGIVIPLQYPVEKKSSARSTQGTTGIREDPDVCLKAP

SEQ ID NO: 63334 - protein, 58 aa, Homo sapiens
MDAVAVYHGKISRETGEKLLLATGLDGSYLLRDSESVPGVYCLCVLHHWGYIKFINKL

SEQ ID NO: 63335 - protein, 77 aa, Homo sapiens
MDLPYYHGRLTKQDCETLLLKEGVDGNFLLRDSESIPGVLCLCVSFKNIVYTYRIFREKHGYYRIQNSNSDYVDVLP

SEQ ID NO: 63336 - protein, 132 aa, Homo sapiens
MDLPYYHGRLTKQDCETLLLKEGVDGNFLLRDSESIPGVLCLCVSFKNIVYTYRIFREKHGYYRIQTAEGSPKQVFPSLKELISKFEKPNQGMVVHLLKPIKRTSPSLRWRGLKLELETFVNSNSDYVDVLP

SEQ ID NO: 63337 - protein, 756 aa, Homo sapiens
MNGAPSPEDGASPSSPPLPPPPPPSWREFCESHARAAALDFARRFRLYLASHPQYAGPGAEAAFSRRFAELFLQHFEAEVARASGSLSPPILAPLSPGAEISPHDLSLESCRVGGPLAVLGPSRSSEDLAGPLPSSVSSSSTTSSKPKLKKRFSLRSVGRSVRGSVRGILQWRGTVDPPSSAGPLETSSGPPVLGGNSNSNSSGGAGTVGRGLVSDGTSPGERWTHRFERLRLSRGGGALKDGAGMVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPTGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQEPTTSHDPPQPPEPPSWTDPPQPGAEEASRAPEVAAAAAAAAKERQEKEKAGGGGVPEELVPVVELVPVVELEEAIAPGSEAQGAGSGGDAGVPPMVQLQQSPLGGDGEEGGHPRAINNQYSFV

SEQ ID NO: 63338 - protein, 671 aa, Homo sapiens
MNGAPSPEDGASPSSPPLPPPPPPSWREFCESHARAAALDFARRFRLYLASHPQYAGPGAEAAFSRRFAELFLQHFEAEVARASGSLSPPILAPLSPGAEISPHDLSLESCRVGGPLAVLGPSRSSEDLAGPLPSSVSSSSTTSSKPKLKKRFSLRSVGRSVRGSVRGILQWRGTVDPPSSAGPLETSSGPPVLGGNSNSNSSGGAGTVGRGLVSDGTSPGERWTHRFERLRLSRGGGALKDGAGMVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPTGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGREQAGSHAGVCEGDGCHPDASCTLMPFGASDCVTDHLP

SEQ ID NO: 63339 - protein, 683 aa, Homo sapiens
MNGAPSPEDGASPSSPPLPPPPPPSWREFCESHARAAALDFARRFRLYLASHPQYAGPGAEAAFSRRFAELFLQHFEAEVARASGSLSPPILAPLSPGAEISPHDLSLESCRVGGPLAVLGPSRSSEDLAGPLPSSVSSSSTTSSKPKLKKRFSLRSVGRSVRGSVRGILQWRGTVDPPSSAGPLETSSGPPVLGGNSNSNSSGGAGTVGRGLVSDGTSPGERWTHRFERLRLSRGGGALKDGAGMVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPTGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGEQSRSAGEEVPVHPRSEAGSRLGAMRGCAREMDATPMPPAPSCPSERVTV

SEQ ID NO: 63340 - protein, 671 aa, Homo sapiens; identical to SEQ ID NO: 63338

SEQ ID NO: 63341 - protein, 335 aa, Homo sapiens
MPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPTGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGREQAGSHAGVCEGDGCHPDASCTLMPFGASDCVTDHLP

SEQ ID NO: 63342 - protein, 373 aa, Homo sapiens
MAEASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPTGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGEQSRSAGEEVPVHPRSEAGSRLGAMRGCAREMDATPMPPAPSCPSERVTV

SEQ ID NO: 63343 - protein, 575 aa, Homo sapiens
MNGPALQPSSPSSAPSASPAAAPRGWSEFCELHAVAAARELARQYWLFAREHPQHAPLRAELVSLQFTDLFQRYFCREVRDGRAPGRDYRDTGRGPPAKAEASPEPGPGPAAPGLPKARSSEELAPPRPPGPCSFQHFRRSLRHIFRRRSAGELPAAHTAAAPGTPGEAAETPARPGLAKKFLPWSLAREPPPEALKEAVLRYSLADEASMDSGARWQRGRLALRRAPGPDGPDRVLELFDPPKSSRPKLQAACSSIQEVRWCTRLEMPDNLYTFVLKVKDRTDIIFEVGDEQQLNSWMAELSECTGRGLESTEAEMHIPSALEPSTSSSPRGSTDSLNQGASPGGLLDPACQKTDHFLSCYPWFHGPISRVKAAQLVQLQGPDAHGVFLVRQSETRRGEYVLTFNFQGIAKHLRLSLTERGQCRVQHLHFPSVVDMLHHFQRSPIPLECGAACDVRLSSYVVVVSQPPGSCNTVLFPFSLPHWDSESLPHWGSELGLPHLSSSGCPRGLSPEGLPGRSSPPEQIFHLVPSPEELANSLQHLEHEPVNRARDSDYEMDSSSRSHLRAIDNQYTPL

SEQ ID NO: 63344 - protein, 373 aa, Homo sapiens
MGFPVLCRGWRRTWPGCASWLGAPPPQKPLLSPLLLNHRSSKSSRPKLQAACSSIQEVRWCTRLEMPDNLYTFVLKVKDRTDIIFEVGDEQQLNSWMAELSECTGRGLESTEAEMHIPSALEPSTSSSPRGSTDSLNQGASPGGLLDPACQKTDHFLSCYPWFHGPISRVKAAQLVQLQGPDAHGVFLVRQSETRRGEYVLTFNFQGIAKHLRLSLTERGQCRVQHLHFPSVVDMLHHFQRSPIPLECGAACDVRLSSYVVVVSQPPGSCNTVLFPFSLPHWDSESLPHWGSELGLPHLSSSGCPRGLSPEGLPGRSSPPEQIFHLVPSPEELANSLQHLEHEPVNRARDSDYEMDSSSRSHLRAIDNQYTPL

SEQ ID NO: 63345 - protein, 402 aa, Homo sapiens
MIPPSSPREDGVDGLPKEAVGAEQPPSPASTSSQESKLQKLKRSLSFKTKSLRSKSADNFFQRTNSEDMKLQAHMVAEISPSSSPLPAPGSLTSTPARAGLHPGGKAHAFQEYIFKKPTFCDVCNHMIVGTNAKHGLRCKACKMSIHHKCTDGLAPQRCMGKLPKGFRRYYSSPLLIHEQFGCIKEVMPIACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMRPGDIITLLEDSNEDWWKGKIQDRIGFFPANFVQRLQQNEKIFRCVRTFIGCKEQGQITLKENQICVSSEEEQDGFIRVLSGKKKGLIPLDVLENI

SEQ ID NO: 63346 - protein, 334 aa, Homo sapiens
MKLQAHMVAEISPSSSPLPAPGSLTSTPARAGLHPGGKAHAFQEYIFKKPTFCDVCNHMIVGTNAKHGLRCKACKMSIHHKCTDGLAPQRCMGKLPKGFRRYYSSPLLIHEQFGCIKEVMPIACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMRPGDIITLLEDSNEDWWKGKIQDRIGFFPANFVQRLQQNEKIFRCVRTFIGCKEQGQITLKENQICVSSEEEQDGFIRVLSGKKKGLIPLDVLENI

SEQ ID NO: 63347 - protein, 1473 aa, Homo sapiens
VAIIAGNFELAEYIKNHKETDIVPFREAPAYSNRRRRPPNTLAAPRVLLRSNSDNNLNASAPDWAVCSTATSHRSLSPQLLQQMPSKPEGAAKTIGSYVPGPRSRSPSLNRLGGAGEDGKRPQPLWHVGSPFALGANKDSLSAFEYPGPKRKLYSAVPGRLFVAVKPYQPQVDGEIPLHRGDRVKVLSIGEGGFWEGSARGHIGWFPAECVEEVQCKPRDSQAETRADRSKKLFRHYTVGSYDSFDTSSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 63348 - protein, 1850 aa, Homo sapiens
MPRSPTSSEDEMAQSFSDYSVGSESDSSKEETIYDTIRATAEKPGGARTEESQGNTLVIRVVIHDLQQTKCIRFNPDATVWVAKQRILCTLTQSLKDVLNYGLFQPASNGRDGKFLDEERLLREYPQPVGEGVPSLEFRYKKRVYKQASLDEKQLAKLHTKTNLKKCMDHIQHRLVEKITKMLDRGLDPNFHDPETGETPLTLAAQLDDSVEVIKALKNGGAHLDFRAKDGMTALHKAARARNQVALKTLLELGASPDYKDSYGLTPLYHTAIVGGDPYCCELLLHEHATVCCKDENGWHEIHQSRCWGHISEPHHTLLSGSARSQQSRSASSALHVCAMYSSFSCVRISLLFHGRITELKQYKKSTPFQVAIIAGNFELAEYIKNHKETDIVPFREAPAYSNRRRRPPNTLAAPRVLLRSNSDNNLNASAPDWAVCSTATSHRSLSPQLLQQMPSKPEGAAKTIGSYVPGPRSRSPSLNRLGGAGEDGKRPQPLWHVGSPFALGANKDSLSAFEYPGPKRKLYSAVPGRLFVAVKPYQPQVDGEIPLHRGDRVKVLSIGEGGFWEGSARGHIGWFPAECVEEVQCKPRDSQAETRADRSKKLFRHYTVGSYDSFDTSSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKGVIRKVSDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 63349 - protein, 281 aa, Homo sapiens
MMMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKGVIRKGKDKPEEIVPASKPSRAAENMAVEPRVATIKQRPSSRCFPAGSDMNSVYERQGIAVMTPTVPGSPKAPFLGIPRGTMRRQKSIGKKCGTPPQKLPLGFQTQP

SEQ ID NO: 63350 - protein, 1253 aa, Homo sapiens
MMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 63351 - protein, 280 aa, Homo sapiens
MMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKASVRKKKDKPEEIVPASKPSRAAENMAVEPRVATIKQRPSSRCFPAGSDMNSVYERQGIAVMTPTVPGSPKAPFLGIPRGTMRRQKSIGKKCGTPPQKLPLGFQTQP

SEQ ID NO: 63352 - protein, 1470 aa, Homo sapiens
MKSLLNAFTKKEVPFREAPAYSNRRRRPPNTLAAPRVLLRSNSDNNLNASAPDWAVCSTATSHRSLSPQLLQQMPSKPEGAAKTIGSYVPGPRSRSPSLNRLGGAGEDGKRPQPLWHVGSPFALGANKDSLSAFEYPGPKRKLYSAVPGRLFVAVKPYQPQVDGEIPLHRGDRVKVLSIGEGGFWEGSARGHIGWFPAECVEEVQCKPRDSQAETRADRSKKLFRHYTVGSYDSFDTSSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKASVRKKKDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 63353 - protein, 271 aa, Homo sapiens
MMMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELDKPEEIVPASKPSRAAENMAVEPRVATIKQRPSSRCFPAGSDMNSVYERQGIAVMTPTVPGSPKAPFLGIPRGTMRRQKSIGKKCGTPPQKLPLGFQTQP

SEQ ID NO: 63354 - protein, 1254 aa, Homo sapiens
MMMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 63355 - protein, 304 aa, Homo sapiens
MPRSPTSSEDEMAQSFSDYSVGSESDSSKEETIYDTIRATAEKPGGARTEESQGNTLVIRVVIHDLQQTKCIRFNPDATVWVAKQRILCTLTQSLKDVLNYGLFQPASNGRDGKFLDEERLLREYPQPVGEGVPSLEFRYKKRVYKQASLDEKQLAKLHTKTNLKKCMDHIQHRLVEKITKMLDRGLDPNFHDPETGETPLTLAAQLDDSVEVIKALKNGGAHLDFRAKDGMTALHKAARARNQVALKTLLELGASPDYKDSYGLTPLYHTAIVGGDPYCCELLLHEHATVCCKDENGWHEIHQ

SEQ ID NO: 63356 - protein, 1747 aa, Homo sapiens
MDGPGASAVVVRVGIPDLQQTKCLRLDPAAPVWAAKQRVLCALNHSLQDALNYGLFQPPSRGRAGKFLDEERLLQEYPPNLDTPLPYLEFRYKRRVYAQNLIDDKQFAKLHTKANLKKFMDYVQLHSTDKVARLLDKGLDPNFHDPDSGECPLSLAAQLDNATDLLKVLKNGGAHLDFRTRDGLTAVHCATRQRNAAALTTLLDLGASPDYKDSRGLTPLYHSALGGGDALCCELLLHDHAQLGITDENGWQEIHQACRFGHVQHLEHLLFYGADMGAQNASGNTALHICALYNQESCARVLLFRGANRDVRNYNSQTAFQVAIIAGNFELAEVIKTHKDSDVVPFRETPSYAKRRRLAGPSGLASPRPLQRSASDINLKGEAQPAASPGPSLRSLPHQLLLQRLQEEKDRDRDADQESNISGPLAGRAGQSKISDPGPGPGGVGGAPLPPPGAPRSCIRIRARFPAPPAPPAPPPRGPKRKLYSAVPGRKFIAVKAHSPQGEGEIPLHRGEAVKVLSIGEGGFWEGTVKGRTGWFPADCVEEVQMRQHDTRPETREDRTKRLFRHYTVGSYDSLTSHSDYVIDDKVAVLQKRDHEGFGFVLRGAKAETPIEEFTPTPAFPALQYLESVDVEGVAWRAGLRTGDFLIEVNGVNVVKVGHKQVVALIRQGGNRLVMKVVSVTRKPEEDGARRRAPPPPKRAPSTTLTLRSKSMTAELEELASIRRRKGEKLDEMLAAAAEPTLRPDIADADSRAATVKQRPTSRRITPAEISSLFERQGLPGPEKLPGSLRKGIPRTKSVGEDEKLASLLEGRFPRSTSMQDPVREGRGIPPPPQTAPPPPPAPYYFDSGPPPAFSPPPPPGRAYDTVRSSFKPGLEARLGAGAAGLYEPGAALGPLPYPERQKRARSMIILQDSAPESGDAPRPPPAATPPERPKRRPRPPGPDSPYANLGAFSASLFAPSKPQRRKSPLVKQLQVEDAQERAALAVGSPGPGGGSFAREPSPTHRGPRPGGLDYGAGDGPGLAFGGPGPAKDRRLEERRRSTVFLSVGAIEGSAPGADLPSLQPSRSIDERLLGTGPTAGRDLLLPSPVSALKPLVSGPSLGPSGSTFIHPLTGKPLDPSSPLALALAARERALASQAPSRSPTPVHSPDADRPGPLFVDVQARDPERGSLASPAFSPRSPAWIPVPARREAEKVPREERKSPEDKKSMILSVLDTSLQRPAGLIVVHATSNGQEPSRLGGAEEERPGTPELAPAPMQSAAVAEPLPSPRAQPPGGTPADAGPGQGSSEEEPELVFAVNLPPAQLSSSDEETREELARIGLVPPPEEFANGVLLATPLAGPGPSPTTVPSPASGKPSSEPPPAPESAADSGVEEADTRSSSDPHLETTSTISTVSSMSTLSSESGELTDTHTSFADGHTFLLEKPPVPPKPKLKSPLGKGPVTFRDPLLKQSSDSELMAQQHHAASAGLASAAGPARPRYLFQRRSKLWGDPVESRGLPGPEDDKPTVISELSSRLQQLNKDTRSLGEEPVGGLGSLLDPAKKSPIAAARLFSSLGELSSISAQRSPGGPGGGASYSVRPSGRYPVARRAPSPVKPASLERVEGLGAGAGGAGRPFGLTPPTILKSSSLSIPHEPKEVRFVVRSVSARSRSPSPSPLPSPASGPGPGAPGPRRPFQQKPLQLWSKFDVGDWLESIHLGEHRDRFEDHEIEGAHLPALTKDDFVELGVTRVGHRMNIERALRQLDGS

SEQ ID NO: 63357 - protein, 1742 aa, Homo sapiens
MDGPGASAVVVRVGIPDLQQTKCLRLDPAAPVWAAKQRVLCALNHSLQDALNYGLFQPPSRGRAGKFLDEERLLQEYPPNLDTPLPYLEFRYKRRVYAQNLIDDKQFAKLHTKANLKKFMDYVQLHSTDKVARLLDKGLDPNFHDPDSGECPLSLAAQLDNATDLLKVLKNGGAHLDFRTRDGLTAVHCATRQRNAAALTTLLDLGASPDYKDSRGLTPLYHSALGGGDALCCELLLHDHAQLGITDENGWQEIHQACRFGHVQHLEHLLFYGADMGAQNASGNTALHICALYNQESCARVLLFRGANRDVRNYNSQTAFQVAIIAGNFELAEVIKTHKDSDVVPFRETPSYAKRRRLAGPSGLASPRPLQRSASDINLKGEAQPAASPGPSLRSLPHQLLLQRLQEEKDRDRDADQESNISGPLAGRAGQSKISEPGAPRSCIRIRARFPAPPAPPAPPPRGPKRKLYSAVPGRKFIAVKAHSPQGEGEIPLHRGEAVKVLSIGEGGFWEGTVKGRTGWFPADCVEEVQMRQHDTRPETREDRTKRLFRHYTVGSYDSLTSHSDYVIDDKVAVLQKRDHEGFGFVLRGAKAETPIEEFTPTPAFPALQYLESVDVEGVAWRAGLRTGDFLIEVNGVNVVKVGHKQVVALIRQGGNRLVMKVVSVTRKPEEDGARRRAPPPPKRAPSTTLTLRSKSMTAELEELGEWRGREGSEKLDEMLAAAAEPTLRPDIADADSRAATVKQRPTSRRITPAEISSLFERQGLPGPEKLPGSLRKGIPRTKSVGEDEKLASLLEGRFPRSTSMQDPVREGRGIPPPPQTAPPPPPAPYYFDSGPPPAFSPPPPPGRAYDTVRSSFKPGLEARLGAGAAGLYEPGAALGPLPYPERQKRARSMIILQDSAPESGDAPRPPPAATPPERPKRRPRPPGPDSPYANLGAFSASLFAPSKPQRRKSPLVKQLQVEDAQERAALAVGSPGPGGGSFAREPSPTHRGPRPGGLDYGAGDGPGLAFGGPGPAKDRRLEERRRSTVFLSVGAIEGSAPGADLPSLQPSRSIDERLLGTGPTAGRDLLLPSPVSALKPLVSGPSLGPSGSTFIHPLTGKPLDPSSPLALALAARERALASQAPSRSPTPVHSPDADRPGPLFVDVQARDPERGSLASPAFSPRSPAWIPVPARREAEKVPREERKSPEDKKSMILSVLDTSLQRPAGLIVVHATSNGQEPSRLGGAEEERPGTPELAPAPMQSAAVAEPLPSPRAQPPGGTPADAGPGQGSSEEEPELVFAVNLPPAQLSSSDEETREELARIGLVPPPEEFANGVLLATPLAGPGPSPTTVPSPASGKPSSEPPPAPESAADSGVEEADTRSSSDPHLETTSTISTVSSMSTLSSESGELTDTHTSFADGHTFLLEKPPVPPKPKLKSPLGKGPVTFRDPLLKQSSDSELMAQQHHAASAGLASAAGPARPRYLFQRRSKLWGDPVESRGLPGPEDDKPTVISELSSRLQQLNKDTRSLGEEPVGGLGSLLDPAKKSPIAAARCRSPMVGLRLFSSLGELSSISAQRSPGGPGGGASYSVRPSGRYPVARRAPSPVKPASLERVEGLGAGAGGAGRPFGLTPPTILKSSSLSIPHEPKEVRFVVRSVSARSRSPSPSPLPSPASGPGPGAPGPRRPFQQKPLQLWSKFDVGDWLESIHLGEHRDRFEDHEIEGAHLPALTKDDFVELGVTRVGHRMNIERALRQLDGS

SEQ ID NO: 63358 - protein, 911 aa, Homo sapiens
MPPRRSIVEVKVLDVQKRRVPNKHYVYIIRVTWSSGSTEAIYRRYSKFFDLQMQMLDKFPMEGGQKDPKQRIIPFLPGKILFRRSHIRDVAVKRLIPIDEYCKALIQLPPYISQCDEVLQFFETRPEDLNPPKEEHIGKKKSGGDQTSVDPMVLEQYVVVANYQKQESSEISLSVGQVVDIIEKNESGWWFVSTAEEQGWVPATCLEGQDGVQDEFSLQPEEEEKYTVIYPYTARDQDEMNLERGAVVEVIQKNLEGWWKIRYQGKEGWAPASYLKKNSGEPLPPKPGPGSPSHPGALDLDGVSRQQNAVGREKELLSSQRDGRFEGRPVPDGDAKQRSPKMRQRPPPRRDMTIPRGLNLPKPPIPPQVEEEYYTIAEFQTTIPDGISFQAGLKVEVIEKNLSGWWYIQIEDKEGWAPATFIDKYKKTSNASRPNFLAPLPHEVTQLRLGEAAALENNTGSEATGPSRPLPDAPHGVMDSGLPWSKDWKGSKDVLRKASSDMSASAGYEEISDPDMEEKPSLPPRKESIIKSEGELLERERERQRTEQLRGPTPKPPGVILPMMPAKHIPPARDSRRPEPKPDKSRLFQLKNDMGLECGHKVLAKEVKKPNLRPISKSKTDLPEEKPDATPQNPFLKSRPQVRPKPAPSPKTEPPQGEDQVDICNLRSKLRPAKSQDKSLLDGEGPQAVGGQDVAFSRSFLPGEGPGRAQDRTGKQDGLSPKEISCRAPPRPAKTTDPVSKSVPVPLQEAPQQRPVVPPRRPPPPKKTSSSSRPLPEVRGPQCEGHESRAAPTPGRALLVPPKAKPFLSNSLGGQDDTRGKGSLGPWGTGKIGENREKAAAASVPNADGLKDSLYVAVADFEGDKDTSSFQEGTVFEVREKNSSGWWFCQVLSGAPSWEGWIPSNYLRKKP

SEQ ID NO: 63359 - protein, 934 aa, Homo sapiens
MEEIWKFSTYLNLGYVSMCLEHLLFDHKYWLNCILVEDTEIQVSVDDKHLETIYLGLLIQEGHFFCRALCSVTPPAEKEGECLTLCKNELISVKMAEAGSELEGVSLVTGQRGLVLVSALEPLPLPFHQWFLKNYPGSCGLSRKRDWTGSYQIGRGRCKALTGYEPGEKDELNFYQGESIEIIGFVIPGLQWFIGKSTSSGQVGFVPTRNIDPDSYSPMSRNSAFLSDEERCSLLALGSDKQTECSSFLHTLARTDITSVYRLSGFESIQNPPNDLSASQPEGFKEVRPGRAWEEHQAVGSRQSSSSEDSSLEEELLSATSDSYRLPEPDDLDDPELLMDLSTGQEEEAENFAPILAFLDHEGYADHFKSLYDFSFSFLTSSFYSFSEEDEFVAYLEASRKWAKKSHMTWAHARLCFLLGRLSIRKVKLSQARVYFEEAIHILNGAFEDLSLVATLYINLAAIYLKQRLRHKGSALLEKAGALLACLPDRESSAKHELDVVAYVLRQGIVVGSSPLEARACFLAIRLLLSLGRHEEVLPFAERLQLLSGHPPASEAVASVLSFLYDKKYLPHLAVASVQQHGIQSAQGMSLPIWQVHLVLQNTTKLLGFPSPGWGEVSALACPMLRQALAACEELADRSTQRALCLILSKVYLEHRSPDGAIHYLSQALVLGQLLGEQESFESSLCLAWAYLLASQAKKALDVLEPLLCSLKETESLTQRGVIYNLLGLALQGEGRVNRAAKSYLRALNRAQEVGDVHNQAVAMANLGHLSLKSWAQHPARNYLLQAVRLYCELQASKETDMELVQVFLWLAQVLVSGHQLTHGLLCYEMALLFGLRHRHLKSKYVPCCWEAIEKSVGSSFIHFLSQVISFMSLLCVQVSFRPPNPSAISTALCPQTLRHASPTMSTGWPWLSNSGTGRWKGGCWSPWGSFIGT

SEQ ID NO: 63360 - protein, 150 aa, Homo sapiens
MSEQMMQSVGCRISLSVFQFLGDQRQELVAFHRLATVYYSLHMYEMAEDCYLKTLSLCPPWLQSPKEALYYAKVYYRLGRLTFCQLKDAHDATEYFLLALAAAVLLGDEELQDTIRSRLDNICQSPLWHSRPSGCSSERARWLSGGGLAL

SEQ ID NO: 63361 - protein, 1288 aa, Homo sapiens
MGGCFCIPRERSLTRGPGKETPSKDPTVSSECIASSEYKEKCFLPQNINPDLTLSFCVKSRSRRCVNGPLQEAARRRLWALENEDQEVRMLFKDLSARLVSIQSQRAQFLITFKTMEEIWKFSTYLNLGYVSMCLEHLLFDHKYWLNCILVEDTEIQVSVDDKHLETIYLGLLIQEGHFFCRALCSVTPPAEKEGECLTLCKNELISVKMAEAGSELEGVSLVTGQRGLVLVSALEPLPLPFHQWFLKNYPGSCGLSRKRDWTGSYQIGRGRCKALTGYEPGEKDELNFYQGESIEIIGFVIPGLQWFIGKSTSSGQVGFVPTRNIDPDSYSPMSRNSAFLSDEERCSLLALGSDKQTECSSFLHTLARTDITSVYRLSGFESIQNPPNDLSASQPEGFKEVRPGRAWEEHQAVGSRQSSSSEDSSLEEELLSATSDSYRLPEPDDLDDPELLMDLSTGQEEEAENFAPILAFLDHEGYADHFKSLYDFSFSFLTSSFYSFSEEDEFVAYLEASRKWAKKSHMTWAHARLCFLLGRLSIRKVKLSQARVYFEEAIHILNGAFEDLSLVATLYINLAAIYLKQRLRHKGSALLEKAGALLACLPDRESSAKHELDVVAYVLRQGIVVGSSPLEARACFLAIRLLLSLGRHEEVLPFAERLQLLSGHPPASEAVASVLSFLYDKKYLPHLAVASVQQHGIQSAQGMSLPIWQVHLVLQNTTKLLGFPSPGWGEVSALACPMLRQALAACEELADRSTQRALCLILSKVYLEHRSPDGAIHYLSQALVLGQLLGEQESFESSLCLAWAYLLASQAKKALDVLEPLLCSLKETESLTQRGVIYNLLGLALQGEGRVNRAAKSYLRALNRAQEVGDVHNQAVAMANLGHLSLKSWAQHPARNYLLQAVRLYCELQASKETDMELVQVFLWLAQVLVSGHQLTHGLLCYEMALLFGLRHRHLKSQLQATKSLCHFYSSVSPNPEACITYHEHWLALAQQLRDREMEGRLLESLGQLYRNLNTARSLRRSLTCIKESLRIFIDLGETDKAAEAWLGAGRLHYLMQEDELVELCLQAAIQTALKSEEPLLALKLYEEAGDVFFNGTRHRHHAVEYYRAGAVPLARRLKAVRTELRIFNKLTELQISLEGYEKALEFATLAARLSTVTGDQRQELVAFHRLATVYYSLHMYEMAEDCYLKTLSLCPPWLQSPKEALYYAKVYYRLGRLTFCQLKDAHDATEYFLLALAAAVLLGDEELQDTIRSRLDNICQSPLWHSRPSGCSSERARWLSGGGLAL

SEQ ID NO: 63362 - protein, 726 aa, Homo sapiens
MDLSTGQEEEAENFAPILAFLDHEGYADHFKSLYDFSFSFLTSSFYSFSEEDEFVAYLEASRKWAKKSHMTWAHARLCFLLGRLSIRKVKLSQARVYFEEAIHILNGAFEDLSLVATLYINLAAIYLKQRLRHKGSALLEKAGALLACLPDRESSAKHELDVVAYVLRQGIVVGSSPLEARACFLAIRLLLSLGRHEEVLPFAERLQLLSGHPPASEAVASVLSFLYDKKYLPHLAVASVQQHGIQSAQGMSLPIWQVHLVLQNTTKLLGFPSPGWGEVSALACPMLRQALAACEELADRSTQRALCLILSKVYLEHRSPDGAIHYLSQALVLGQLLGEQESFESSLCLAWAYLLASQAKKALDVLEPLLCSLKETESLTQRGVIYNLLGLALQGEGRVNRAAKSYLRALNRAQEVGDVHNQAVAMANLGHLSLKSWAQHPARNYLLQAVRLYCELQASKETDMELVQVFLWLAQVLVSGHQLTHGLLCYEMALLFGLRHRHLKSQLQATKSLCHFYSSVSPNPEACITYHEHWLALAQQLRDREMEGRLLESLGQLYRNLNTARSLRRSLTCIKESLRIFIDLGETDKAAEAWLGAGRLHYLMQEDELVELCLQAAIQTALKSEEPLLALKLYEEAGDVFFNGTRHRHHAVEYYRAGAVPLARRLKAVRTELRIFNKLTELQISLEGYEKALEFATLAARLSTVTEARAGGLSPPGYSVLLPAHV

SEQ ID NO: 63363 - protein, 239 aa, Homo sapiens
MPLLLLGETEPLKLERDCRSPVDPWAAASPDLALACLCHCQDLSSGAFPDRGVLGGVLFPTVEMVIKVFVATSSGSIAIRKKQQEVVGFLEANKIDFKELDIAGDEDNRRWMRENVPGEKKPQNGIPLPPQIFNEEQYCGDFDSFFSAKEENIIYSFLGLAPPPDSKGSEKAEEGGETEAQKEGSEDVGNLPEAQEKNEEEGETATEETEEIAMEGAEGEAEEEEETAEGEEPGEDEDS

SEQ ID NO: 63364 - protein, 128 aa, Homo sapiens
MRENVPGEKKPQNGIPLPPQIFNEEQYCGDFDSFFSAKEENIIYSFLGLAPPPDSKGSEKAEEGGETEAQKEGSEDVGNLPEAQEKNEEEGETATEETEEIAMEGAEGEAEEEEETAEGEEPGEDEDS

SEQ ID NO: 63365 - protein, 128 aa, Homo sapiens; identical to SEQ ID NO: 63364

SEQ ID NO: 63366 - protein, 128 aa, Homo sapiens; identical to SEQ ID NO: 63364

SEQ ID NO: 63367 - protein, 106 aa, Homo sapiens
MRENVPGEKKPQNGIPLPPQIFNEEQYCGDFDSFFSAKEENIIYSFLGLAPPPDSKGSEKAEEGGETEAQKEGSEDVGNLPEAQEKNEEEGETATEETEEIAMEGA

SEQ ID NO: 63368 - protein, 790 aa, Homo sapiens
MNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMLSVPHGIANEDIVSQNPGELSCKRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 63369 - protein, 790 aa, Homo sapiens; identical to SEQ ID NO: 63368

SEQ ID NO: 63370 - protein, 767 aa, Homo sapiens
MNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 63371 - protein, 731 aa, Homo sapiens
MNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLGLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 63372 - protein, 731 aa, Homo sapiens; identical to SEQ ID NO: 63371

SEQ ID NO: 63373 - protein, 767 aa, Homo sapiens; identical to SEQ ID NO: 63370

SEQ ID NO: 63374 - protein, 767 aa, Homo sapiens; identical to SEQ ID NO: 63370

SEQ ID NO: 63375 - protein, 729 aa, Homo sapiens
MDDLTLLDLLECPVCFEKLDVTAKVLPCQHTFCKPCLQRVFKAHKELRCPECRTPVFSNIEALPANLLLVRLLDGVRSGQSSGRGGSFRRPGTMTLQDGRKSRTNPRRLQASPFRLVPNVRIHMDGVPRAKALCNYRGQNPGDLRFNKGDIILLRRQLDENWYQGEINGISGNFPASSVEVIKQLPQPPPLCRALYNFDLRGKDKSENQDCLTFLKDDIITVISRVDENWAEGKLGDKVGIFPILFVEPNLTARHLLEKNKGRQSSRTKNLSLVSSSSRGNTSTLRRGPGSRRKVPGQFSITTALNTLNRMVHSPSGRHMVEISTPVLISSSNPSVITQPMEKADVPSSCVGQVSTYHPAPVSPGHSTAVVSLPGSQQHLSANMFVALHSYSAHGPDELDLQKGEGVRVLGKCQDGWLRGVSLVTGRVGIFPNNYVIPIFRKTSSFPDSRSPGLYTTWTLSTSSVSSQGSISEGDPRQSRPFKSVFVPTAIVNPVRSTAGPGTLGQGSLRKGRSSMRKNGSLQRPLQSGIPTLVVGSLRRSPTMVLRPQQFQFYQPQGIPSSPSAVVVEMGSKPALTGEPALTCISRGSEAWIHSAASSLIMEDKEIPIKSEPLPKPPASAPPSILVKPENSRNGIEKQVKTVRFQNYSPPPTKHYTSHPTSGKPEQPATLKASQPEAASLGPEMTVLFAHRSGCHSGQQTDLRRKSALGKATTLVSTASGTQTVFPSK

SEQ ID NO: 63376 - protein, 729 aa, Homo sapiens; identical to SEQ ID NO: 63375

SEQ ID NO: 63377 - protein, 128 aa, Homo sapiens
MEDKEIPIKSEPLPKPPASAPPSILVKPENSRNGIEKQVKTVRFQNYSPPPTKHYTSHPTSGKPEQPATLKASQPEAASLGPEMTVLFAHRSGCHSGQQTDLRRKSALGKATTLVSTASGTQTVFPSK

SEQ ID NO: 63378 - protein, 561 aa, Homo sapiens
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKRDPLCPRRAEPCPRVPATPRRMSDPPLSTMPTAPGLRKPPCFRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVPLPNSVFVNTTESCEVERLFKATSPRGEPQDGLYCIRNSSTKSGKVLVVWDETSNKVRNYRIFEKDSKFYLEGEVLFVSVGSMVEHYHTHVLPSHQSLLLRHPYGYTGPR

SEQ ID NO: 63379 - protein, 97 aa, Homo sapiens
MAAEEMHWPVPMKAIGAQNLLTMPGGVAKAGYLHKKGGTQLQLLKWPLRFVIIHKRCVYYFKSSTSASPQGAFSLSGYNRQPRPQPAQALSQTEAGP

SEQ ID NO: 63380 - protein, 561 aa, Homo sapiens; identical to SEQ ID NO: 63378

SEQ ID NO: 63381 - protein, 589 aa, Homo sapiens
MASLGPRTPAPSRSRGRRAMCWVSTISFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKRDPLCPRRAEPCPRVPATPRRMSDPPLSTMPTAPGLRKPPCFRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVPLPNSVFVNTTESCEVERLFKATSPRGEPQDGLYCIRNSSTKSGKVLVVWDETSNKVRNYRIFEKDSKFYLEGEVLFVSVGSMVEHYHTHVLPSHQSLLLRHPYGYTGPR

SEQ ID NO: 63382 - protein, 561 aa, Homo sapiens; identical to SEQ ID NO: 63378

SEQ ID NO: 63383 - protein, 142 aa, Homo sapiens
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDT

SEQ ID NO: 63384 - protein, 142 aa, Homo sapiens; identical to SEQ ID NO: 63383

SEQ ID NO: 63385 - protein, 618 aa, Homo sapiens
MAGSGPRPRSWGRREAGARDEAAAAGGRGPGPCRCSQGRRAWIAPGKPAMPAAWTPFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKRDPLCPRRAEPCPRVPATPRRMSDPPLSTMPTAPGLRKPPCFRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVPLPNSVFVNTTESCEVERLFKATSPRGEPQDGLYCIRNSSTKSGKVLVVWDETSNKVRNYRIFEKDSKFYLEGEVLFVSVGSMVEHYHTHVLPSHQSLLLRHPYGYTGPR

SEQ ID NO: 63386 - protein, 172 aa, Homo sapiens
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNE

SEQ ID NO: 63387 - protein, 188 aa, Homo sapiens
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDS

SEQ ID NO: 63388 - protein, 561 aa, Homo sapiens; identical to SEQ ID NO: 63378

SEQ ID NO: 63389 - protein, 194 aa, Homo sapiens
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRL

SEQ ID NO: 63390 - protein, 136 aa, Homo sapiens
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKK

SEQ ID NO: 63391 - protein, 963 aa, Homo sapiens
MAAQRIRAANSNGLPRCKSEGTLIDLSEGFSETSFNDIKVPSPSALLVDNPTPFGNAKEVIAIKDYCPTNFTTLKFSKGDHLYVLDTSGGEWWYAHNTTEMGYIPSSYVQPLNYRNSTLSDSGMIDNLPDSPDEVAKELELLGGWTDDKKVPGRMYSNNPFWNGVQTNPFLNGNVPVMPSLDELNPKSTVDLLLFDAGTSSFTESSSATTNSTGNIFDELPVTNGLHAEPPVRRDNPFFRSKRSYSLSELSVLQAKSDAPTSSSFFTGLKSPAPEQFQSREDFRTAWLNHRKLARSCHDLDLLGQSPGWGQTQAVETNIVCKLDSSGGAVQLPDTSISIHVPEGHVAPGETQQISMKALLDPPLELNSDRSCSISPVLEVKLSNLEVKTSIILEMKVSAEIKNDLFSKSTVGLQCLRSDSKEGPYVSVPLNCSCGDTVQAQLHNLEPCMYVAVVAHGPSILYPSTVWDFINKKVTVGLYGPKHIHPSFKTVVTIFGHDCAPKTLLVSEVTRQAPNPAPVALQLWGKHQFVLSRPQDLKVCMFSNMTNYEVKASEQAKVVRGFQLKLGKVSRLIFPITSQNPNELSDFTLRVQVKDDQEAILTQFCVQTPQPPPKSAIKPSGQRRFLKKNEVGKIILSPFATTTKYPTFQDRPVSSLKFGKLLKTVVRQNKNHYLLEYKKGDGIALLSEERVRLRGQLWTKEWYIGYYQGRVGLVHTKNVLVVGRARPSLCSGPELSTSVLLEQILRPCKFLTYIYASVRTLLMENISSWRSFADALGYVNLPLTFFCRAELDSEPERVASVLEKLKEDCNNTENKERKSFQKELVMALLKMDCQGLVVRLIQDFVLLTTAVEVAQRWRELAEKLAKVSKQQMDAYESPHRDRNGVVDSEAMWKPAYDFLLTWSHQIGDSYRDVIQELHLGLDKMKNPITKRWKHLTGTLILVNSLDVLRAAAFSPADQDDFVI

SEQ ID NO: 63392 - protein, 963 aa, Homo sapiens; identical to SEQ ID NO: 63391

SEQ ID NO: 63393 - protein, 963 aa, Homo sapiens; identical to SEQ ID NO: 63391

SEQ ID NO: 63394 - protein, 122 aa, Homo sapiens
MAAQRIRAANSNGLPRCKSEGTLIDLSEGFSETSFNDIKVPSPSALLVDNPTPFGNAKEVIAIKDYCPTNFTTLKFSKGDHLYVLDTSGGEWWYAHNTTEMGYIPSSYVQPLNYRNSTLSDS

SEQ ID NO: 63395 - protein, 553 aa, Homo sapiens
MAAQRIRAANSNGLPRCKSEGTLIDLSEGFSETSFNDIKVPSPSALLVDNPTPFGNAKEVIAIKDYCPTNFTTLKFSKGDHLYVLDTSGGEWWYAHNTTEMGYIPSSYVQPLNYRNSTLSDSGMIDNLPDSPDEVAKELELLGGWTDDKKVPGRMYSNNPFWNGVQTNPFLNGNVPVMPSLDELNPKSTVDLLLFDAGTSSFTESSSATTNSTGNIFDELPVTNGLHAEPPVRRDNPFFRSKRSYSLSELSVLQAKSDAPTSSSFFTGLKSPAPEQFQSREDFRTAWLNHRKLARSCHDLDLLGQSPGWGQTQAVETNIVCKLDSSGGAVQLPDTSISIHVPEGHVAPGETQQISMKALLDPPLELNSDRSCSISPVLEVKLSNLEVKTSIILEMKVSAEIKNDLFSKSTVGLQCLRSDSKEGPYVSVPLNCSCGDTVQAQLHNLEPCMYVAVVAHGPSILYPSTVWDFINKKVTVGLYGPKHIHPSFKTVVTIFGHDCAPKTLLVSEVTRQAPNPPITKRWKHLTGTLILVNSLDVLRAAAFSPADQDDFVI

SEQ ID NO: 63396 - protein, 56 aa, Homo sapiens
MAAQRIRAANSNGLPRCKSEGTLIDLSEGFSETSFNDIKVPSPSALLVDNPTPFGN

SEQ ID NO: 63397 - protein, 173 aa, Homo sapiens
MAAQRIRAANSNGLPRCKSEGTLIDLSEGFSETSFNDIKVPSPSALLVDNPTPFGNAKEVIAIKDYCPTNFTTLKFSKGDHLYVLDTSGGEWWYAHNTTEMGYIPSSYVQPLNYRNSTLSDSGMIDNLPDSPDEVAKELELLGGWTDDKKVPGRMYSNNPFWNGVQTNPFLNG

SEQ ID NO: 63398 - protein, 57 aa, Homo sapiens
MAAQRIRAANSNGLPRCKSEGTLIDLSEGFSETSFNDIKVPSPSALLVDNPTPFGNA

SEQ ID NO: 63399 - protein, 201 aa, Homo sapiens
MENISSWRSFADALGYVNLPLTFFCRAELDSEPERVASVLEKLKEDCNNTENKERKSFQKELVMALLKMDCQGLVVRLIQDFVLLTTAVEVAQRWRELAEKLAKVSKQQMDAYESPHRDRNGVVDSEAMWKPAYDFLLTWSHQIGDSYRDVIQELHLGLDKMKNPITKRWKHLTGTLILVNSLDVLRAAAFSPADQDDFVI

SEQ ID NO: 63400 - protein, 298 aa, Homo sapiens
MLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 63401 - protein, 128 aa, Homo sapiens
MLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDL

SEQ ID NO: 63402 - protein, 455 aa, Homo sapiens
MDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 63403 - protein, 298 aa, Homo sapiens; identical to SEQ ID NO: 63400

SEQ ID NO: 63404 - protein, 51 aa, Homo sapiens
MLNHATQRVMEAEQTKTRSELVHKETAARYNAAMGRMRQLEKKLKRAINKS

SEQ ID NO: 63405 - protein, 298 aa, Homo sapiens; identical to SEQ ID NO: 63400

SEQ ID NO: 63406 - protein, 859 aa, Homo sapiens
MMEGLKKRTRKAFGIRKKEKDTDSTGSPDRDGIQGKKKTQKTQLLLTSCFWLRALSLTLSQKKSNGAPNGFYAEIDWERYNSPELDEEGYSIRPEEPGSTKGKHFYSSSESEEEEESHKKFNIKIKPLQSKDILKNAATVDELKASIGNIALSPSPVRKSPRRSPGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGNDQSATEVKIEKLPSINDLDSIFGPVLSPKSVAVNAEEKWVHFSDTSPEHVTPELTPREKVVSPPATPDNPADSPAPGPLGPPGPTGPPGPPGPPRNVLSPLNLEEVQKKVAEQTFIKDDYLETISSPKDFGLGQRATPPPPPPPTYRTVVSSPGPGSGPGPGTTSDGKTEAQRYQVICPSLQAGGNELDSYSGASSPARPATPLVPCRSTTPPPPPPRPPSRPKLPPGKPGVGDVSRPFSPPIHSSSPPPIAPLARAESTSSISSTNSLSAATTPTVENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 63407 - protein, 618 aa, Homo sapiens
MMEGLKKRTRKAFGIRKKEKDTDSTGSPDRDGINSPELDEEGYSIRPEEPGSTKGKHFYSSSESEEEEESHKKFNIKIKPLQSKDILKNAATVDELKASIGNIALSPSPVRKSPRRSPGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGASSPARPATPLVPCRSTTPPPPPPRPPSRPKLPPGKPGVGDVSRPFSPPIHSSSPPPIAPLARAESTSSISSTNSLSAATTPTVENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 63408 - protein, 630 aa, Homo sapiens
MEGLKKRTRKAFGIRKKEKDTDSTGSPDRDGIKKSNGAPNGFYAEIDWERYNSPELDEEGYSIRPEEPGSTKGKHFYSSSESEEEEESHKKFNIKIKPLQSKDILKNAATVDELKASIGNIALSPSPVGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGASSPARPATPLVPCRSTTPPPPPPRPPSRPKLPPGKPGVGDVSRPFSPPIHSSSPPPIAPLARAESTSSISSTNSLSAATTPTVVSEDDVFYDKLPSFERRCETPAGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 63409 - protein, 828 aa, Homo sapiens
MMEGLKKRTRKAFGIRKKEKDTDSTGSPDRDGIQPSPHEPPYNSKAECAREGGKKVSKKSNGAPNGFYAEIDWERYNSPELDEEGYSIRPEEPGSTKGKHFYSSSESEEEEESHKKFNIKIKPLQSKDILKNAATVDELKASIGNIALSPSPVRKSPRRSPGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGNDQSATEVKIEKLPSINDLDSIFGPVLSPKSVAVNAEEKWVHFSDTSPEHVTPELTPREKVVSPPATPDNPADSPAPGPLGPPGPTGPPGPPGPPRNVLSPLNLEEVQKKVAEQTFIKDDYLETISSPKDFGLGQRATPPPPPPPTYRTVVSSPGPGSGPGPGTTSGASSPARPATPLVPCRSTTPPPPPPRPPSRPKLPPGKPGVGDVSRPFSPPIHSSSPPPIAPLARAESTSSISSTNSLSAATTPTVENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 63410 - protein, 858 aa, Homo sapiens
MEGLKKRTRKAFGIRKKEKDTDSTGSPDRDGIQGKKKTQKTQLLLTSCFWLRALSLTLSQKKSNGAPNGFYAEIDWERYNSPELDEEGYSIRPEEPGSTKGKHFYSSSESEEEEESHKKFNIKIKPLQSKDILKNAATVDELKASIGNIALSPSPVRKKERREKGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGNDQSATEVKIEKLPSINDLDSIFGPVLSPKSVAVNAEEKWVHFSDTSPEHVTPELTPREKVVSPPATPDNPADSPAPGPLGPPGPTGPPGPPGPPRNVLSPLNLEEVQKKVAEQTFIKDDYLETISSPKDFGLGQRATPPPPPPPTYRTVVSSPGPGSGPGPGTTSDGKTEAQRYQVICPSLQAGGNELDSYSGASSPARPATPLVPCRSTTPPPPPPRPPSRPKLPPGKPGVGDVSRPFSPPIHSSSPPPIAPLARAESTSSISSTNSLSAATTPTVENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 63411 - protein, 631 aa, Homo sapiens
MMEGLKKRTRKAFGIRKKEKDTDSTGSPDRDGIKKSNGAPNGFYAEIDWERYNSPELDEEGYSIRPEEPGSTKGKHFYSSSESEEEEESHKKFNIKIKPLQSKDILKNAATVDELKASIGNIALSPSPVGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGASSPARPATPLVPCRSTTPPPPPPRPPSRPKLPPGKPGVGDVSRPFSPPIHSSSPPPIAPLARAESTSSISSTNSLSAATTPTVVSEDDVFYDKLPSFERRCETPAGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 63412 - protein, 831 aa, Homo sapiens
MEGLKKRTRKAFGIRKKEKDTDSTGSPDRDGIQGKKKTQKTQLLLTSCFWLRALSLTLSQKKSNGAPNGFYAEIDWERYNSPELDEEGYSIRPEEPGSTKGKHFYSSSESEEEEESHKKFNIKIKPLQSKDILKNAATVDELKASIGNIALSPSPVRKKERREKGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGNDQSATEVKIEKLPSINDLDSIFGPVLSPKSVAVNAEEKWVHFSDTSPEHVTPELTPREKVVSPPATPDNPADSPAPGPLGPPGPTGPPGPPGPPRNVLSPLNLEEVQKKVAEQTFIKDDYLETISSPKDFGLGQRATPPPPPPPTYRTVVSSPGPGSGPGPGTTSGASSPARPATPLVPCRSTTPPPPPPRPPSRPKLPPGKPGVGDVSRPFSPPIHSSSPPPIAPLARAESTSSISSTNSLSAATTPTVENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 63413 - protein, 260 aa, Homo sapiens
MMEGLKKRTRKAFGIRKKEKDTDSTGSPDRDGIQPSPHEPPYNSKAECAREGGKKVSKKSNGAPNGFYAEIDWERYNSPELDEEGYSIRPEEPGSTKGKHFYSSSESEEEEESHKKFNIKIKPLQSKDILKNAATVDELKASIGNIALSPSPVGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLT

SEQ ID NO: 63414 - protein, 333 aa, Homo sapiens
MTCSVTHIVSFSLPFLNPSHPASTPGHTENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 63415 - protein, 368 aa, Homo sapiens
MSVAGLKKQFYKASQLVSEKVGGAEGTKLDDDFKEMEKKVDVTSKAVTEVLARTIEYLQPNPASRAKLTMLNTVSKIRGQVKNPGYPQSEGLLGECMIRHGKELGGESNFGDALLDAGESMKRLAEVKDSLDIEVKQNFIDPLQNLCEKDLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 63416 - protein, 320 aa, Homo sapiens
MSVAGLKKQFYKASQLVSEKVGGAEGTKLDDDFKEMEKKVDVTSKAVTEVLARTIEYLQPNPGDALLDAGESMKRLAEVKDSLDIEVKQNFIDPLQNLCEKDLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 63417 - protein, 304 aa, Homo sapiens
MSVAGLKKQFYKASQLVSEKVGGAEGTKLDDDFKEMEKKVDVTSKAVTEVLARTIEYLQPNPASRAKLTMLNTVSKIRGQNLCEKDLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 63418 - protein, 352 aa, Homo sapiens
MSVAGLKKQFHKATQKVSEKVGGAEGTKLDDDFKEMERKVDVTSRAVMEIMTKTIEYLQPNPASRAKLSMINTMSKIRGQEKGPGYPQAEALLAEAMLKFGRELGDDCNFGPALGEVGEAMRELSEVKDSLDIEVKQNFIDPLQNLHDKDLREIQHHLKKLEGRRLDFDYKKKRQGKIPDEELRQALEKFDESKEIAESSMFNLLEMDIEQVSQLSALVQAQLEYHKQAVQILQQVTVRLEERIRQASSQPRREYQPKPRMSLEFPTGDSTQPNGGLSHTGTPKPSGVQMDQPCCRALYDFEPENEGELGFKEGDIITLTNQIDENWYEGMLHGHSGFFPINYVEILVALPH

SEQ ID NO: 63419 - protein, 225 aa, Homo sapiens
MSVAGLKKQFHKATQKVSEKVGGAEGTKLDDDFKEMERKVDVTSRAVMEIMTKTIEYLQPNPGSLEAEALLAEAMLKFGRELGDDCNFGPALGEVGEAMRELSEVKDSLDIEVKQNFIDPLQNLHDKDLREIQHHLKKLEGRRLDFDYKKKRQGKIPDEELRQALEKFDESKEIAESSMFNLLEMDIEQVSQLSALVQAQLEYHKQAVQILQQVTVRLEERIRQA

SEQ ID NO: 63420 - protein, 305 aa, Homo sapiens [sequence omitted]

SEQ ID NO: 63421 - protein, 181 aa, Homo sapiens
MSVAGLKKQFHKATQKVSEKVGGAEGTKLDDDFKEMEIEQVSQLSALVQAQLEYHKQAVQILQQVTVRLEERIRQASSQPRREYQPKPRMSLEFPTGDSTQPNGGLSHTGTPKPSGVQMDQPCCRALYDFEPENEGELGFKEGDIITLTNQIDENWYEGMLHGHSGFFPINYVEILVALPH

SEQ ID NO: 63422 - protein, 355 aa, Homo sapiens
MDGIFAGIICNQANRCLTWTSQQLFSEKISGAEGTKLDDEFLDMERKIDVTNKVVAEILSKTTEYLQPNPAYRAKLGMLNTVSKIRGQVKTTGYPQTEGLLGDCMLKYGKELGEDSTFGNALIEVGESMKLMAEVKDSLDINVKQTFIDPLQLLQDKDLKEIGHHLKKLEGRRLDYDYKKKRVGKIPDEEVRQAVEKFEESKELAERSMFNFLENDVEQVSQLAVFIEAALDYHRQSTEILQELQSKLQMRISAASSVPRREYKPRPVKRSSSELNGVSTTSVVKTTGSNIPMDQPCCRGLYDFEPENQGELGFKEGDIITLTNQIDENWYEGMIHGESGFFPINYVEVIVPLPQ

SEQ ID NO: 63423 - protein, 347 aa, Homo sapiens
MSVAGLKKQFHKASQLFSEKISGAEGTKLDDEFLDMERKIDVTNKVVAEILSKTTEYLQPNPAYRAKLGMLNTVSKIRGQVKTTGYPQTEGLLGDCMLKYGKELGEDSTFGNALIEVGESMKLMAEVKDSLDINVKQTFIDPLQLLQDKDLKEIGHHLKKLEGRRLDYDYKKKRVGKIPDEEVRQAVEKFEESKELAERSMFNFLENDVEQVSQLAVFIEAALDYHRQSTEILQELQSKLQMRISAASSVPRREYKPRPVKRSSSELNGVSTTSVVKTTGSNIPMDQPCCRGLYDFEPENQGELGFKEGDIITLTNQIDENWYEGMIHGESGFFPINYVEVIVPLPQ

SEQ ID NO: 63424 - protein, 355 aa, Homo sapiens; identical to SEQ ID NO: 63422

SEQ ID NO: 63425 - protein, 288 aa, Homo sapiens
MSVAGLKKQFHKASQLFSEKISGAEGTKLDDEFLDMERKIDVTNKVVAEILSKTTEYLQPNPAYRAKLGMLNTVSKIRGQVKTTGYPQTEGLLGDCMLKYGKELGEDSTFGNALIEVGESMKLMAEVKDSLDINVKQTFIDPLQLLQDKDLKEIGHHLKKLEGRRLDYDYKKKRVGKIPDEEVRQAVEKFEESKELAERSMFNFLENDVEQVSQLAVFIEAALDYHRQSTEILQELQSKLQMRISAASSVPRREYKPRPVKRSSSELNGVSTTSVVKTTAYSRLEPAD

SEQ ID NO: 63426 - protein, 553 aa, Homo sapiens
MVEAIVEFDYQAQHDDELTISVGEIITNIRKEDGGWWEGQINGRRGLFPDNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSRPEGLPPASLLPFPAHGAKGKTTFEGTILYRAAPGKTEGHRRYYSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRYCCALTSGAGVGWLWKEHRRGTDCHRPWEEGRGEGGAQASLLHPPAKLSEDTGHFCPCSCTQAGVSVRLRGAVWVS

SEQ ID NO: 63427 - protein, 628 aa, Homo sapiens
MEVSAAKAPSAADLSEIEIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 63428 - protein, 650 aa, Homo sapiens
MKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSRPEGLPPASLLPFPAHGAKGKTTFEGTILYRAAPGKTEGHRRYYSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 63429 - protein, 427 aa, Homo sapiens
MGEETIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 63430 - protein, 645 aa, Homo sapiens
LTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSRPEGLPPASLLPFPAHGAKGKTTFEGTILYRAAPGKTEGHRRYYSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 63431 - protein, 149 aa, Homo sapiens
FETSERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVE

SEQ ID NO: 63432 - protein, 665 aa, Homo sapiens
MVEAIVEFDYQAQHDDELTISVGEIITNIRKEDGGWWEGQINGRRGLFPDNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 63433 - protein, 149 aa, Homo sapiens
MERSERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVE

SEQ ID NO: 63434 - protein, 208 aa, Homo sapiens
MEIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTE

SEQ ID NO: 63435 - protein, 404 aa, Homo sapiens
MDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 63436 - protein, 151 aa, Homo sapiens
MNWAPATCWALLLAAAFLCDSGAAKGGRGGARGSARGGVRGGARGASRVRVRPAQRYGAPGSSLRVAAAGAAAGAAAGAAAGLAAGSGWRRAAGPGERGLEDEEDGVPGGNGTGPGIYSYRAWTSGAGPTRGPRLCLVLGGALGALGLLRP

SEQ ID NO: 63437 - protein, 151 aa, Homo sapiens; identical to SEQ ID NO: 63436

SEQ ID NO: 63438 - protein, 326 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALQVHPHCTVAALQEQVFSELGFPPAVQRWVIGRCLCVPERSLASYGVRQDGDPAFLYLLSAPREAPAQLVLSFLHLHQCPRPPWL

SEQ ID NO: 63439 - protein, 387 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALQVHPHCTVAALQEQVFSELGFPPAVQRWVIGRCLCVPERSLASYGVRQDGDPAFLYLLSAPREAPATGPSPQHPQKMDGELGRLFPPSLGLPPGPQPAASSLPSPLQPSWSCPSCTFINAPDRPGCEMCSTQRPCTWDPLAAAST

SEQ ID NO: 63440 - protein, 672 aa, Homo sapiens
MADGSLTGGGLEAAAMAPERMGWAVEQELASLEKGLFQDEDSCSDCSYRDKPGSSLQSFMPEGKTFFPEIFQTNQLLFYERFRAYQDYILADCKASEVQEFTAEFLEKVLEPSGWRAVWHTNVFKVLVEITDVDFAALKAVVRLAEPYLCDSQVSTFTMECMKELLDLKEHRLPLQELWVVFDDSGVFDQTALAIEHVRFFYQNIWRSWDEEEEDEYDYFVRCVEPRLRLHYDILEDRVPSGLIVDYHNLLSQCEESYRKFLNLRSSLSNCNSDSEQENISMVEGLKLYSEMEQLKQKLKLIENPLLRYVFGYQKNSNIQAKGVRSSGQKITHVVSSTMMAGLLRSLLTDRLCQEPGEEEREIQFHSDPLSAINACFEGDTVIVCPGHYVVHGTFSIADSIELEGYGLPDDIVIEKRGKGDTFVDCTGADIKISGIKFVQHDAVEGILIVHRGKTTLENCVLQCETTGVTVRTSAEFLMKNSDLYGAKGAGIEIYPGSQCTLSDNGIHHCKEGILIKDFLDEHYDIPKISMVNNIIHNNEGYGVVLVKPTIFSDLQENAEDGTEENKALKIQTSGEPDVAERVDLEELIECATGKMELCARTDPSEQVEGNCEIVNELIAASTQKGQIKKKRLSELGITQADDNLMSQEMFVGIVGNQFKWNGKGSFGTFLF

SEQ ID NO: 63441 - protein, 240 aa, Homo sapiens
MTAPVPAPRILLPLLLLLLLTPPPGARGEVCMASRGLSLFPESCPDFCCGTCDDQYCCSDVLKKFVWSEERCAVPEASVPASVEPVEQLGSALRFRPGYNDPMSGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 63442 - protein, 112 aa, Homo sapiens
MASRGLSLFPESCPDFCCGTCDDQYCCSDVLKKFVWSEERCAVPEASVPASVEPVEQLGSALRFRPGYNDPMSGFGATLAVGLTIFVLSVVTIIICFTCSCCCLYKTCRRPR

SEQ ID NO: 63443 - protein, 137 aa, Homo sapiens
MGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 63444 - protein, 209 aa, Homo sapiens
MASRGLSLFPESCPDFCCGTCDDQYCCSDVLKKFVWSEERCAVPEASVPASVEPVEQLGSALRFRPGYNDPMSGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 63445 - protein, 209 aa, Homo sapiens; identical to SEQ ID NO: 63444

SEQ ID NO: 63446 - protein, 170 aa, Homo sapiens [sequence omitted]

SEQ ID NO: 63447 - protein, 221 aa, Homo sapiens
MRRVLRLLLGCFLTELCARVCRAQERAGHGQLAQLGGVLLLAGGNRSGAASGEASEGAEASDAPPTRAPTPDFCRGYFDVMGQWDPPFNCSSGDFIFCCGTCGFRFCCTFKKRRLNQSTCTNYDTPLWLNTGKPPARKDDPLHDPTKDKTNLIVYIICGVVAVMVLVGIFTKLGLEKAHRPQREHMSRLYDNLLFMEAQISFQEDEPAPGEWSVGLQTWTV

SEQ ID NO: 63448 - protein, 424 aa, Homo sapiens
MRRVLRLLLGCFLTELCARVCRAQERAGHGQLAQLGGVLLLAGGNRSGAASGEASEGAEASDAPPTRAPTPDFCRGYFDVMGQWDPPFNCSSGDFIFCCGTCGFRFCCTFKKRRLNQSTCTNYDTPLWLNTGKPPARKDDPLHDPTKDKTNLIVYIICGVVAVMVLVGIFTKLGLEKAHRPQREHMSRALADVMRPQGHCNTDHMERDLNIVVHVQHYENMDTRTPINNLHATQMNNAVPTSPLLQQMGHPHSYPNLGQISNPYEQQPPGKELNKYASLKAVGSSDGDWAVSTLKSPKADKVNDDFYTKRRHLAELAAKGNLPLHPVRVEDEPRAFSPEHGPAKQNGQKSRTNKMPPHPLAYTSTTNFKGWDPNEQSLRRQAYSNKGKLGTAETGSSDPLGTRPQHYPPPQPYFITNSKTEVTV

SEQ ID NO: 63449 - protein, 262 aa, Homo sapiens
MCGPRRLAAPGSSLGSFGRASRGGRRGSSGGRAAEPGLGDTMRRVLRLLLGCFLTELCARVCRAQERAGHGQLAQLGGVLLLAGGNRSGAASGEASEGAEASDAPPTRAPTPDFCRGYFDVMGQWDPPFNCSSGDFIFCCGTCGFRFCCTFKKRRLNQSTCTNYDTPLWLNTGKPPARKDDPLHDPTKDKTNLIVYIICGVVAVMVLVGIFTKLGLEKAHRPQREHMSRLYDNLLFMEAQISFQEDEPAPGEWSVGLQTWTV

SEQ ID NO: 63450 - protein, 465 aa, Homo sapiens
MCGPRRLAAPGSSLGSFGRASRGGRRGSSGGRAAEPGLGDTMRRVLRLLLGCFLTELCARVCRAQERAGHGQLAQLGGVLLLAGGNRSGAASGEASEGAEASDAPPTRAPTPDFCRGYFDVMGQWDPPFNCSSGDFIFCCGTCGFRFCCTFKKRRLNQSTCTNYDTPLWLNTGKPPARKDDPLHDPTKDKTNLIVYIICGVVAVMVLVGIFTKLGLEKAHRPQREHMSRALADVMRPQGHCNTDHMERDLNIVVHVQHYENMDTRTPINNLHATQMNNAVPTSPLLQQMGHPHSYPNLGQISNPYEQQPPGKELNKYASLKAVGSSDGDWAVSTLKSPKADKVNDDFYTKRRHLAELAAKGNLPLHPVRVEDEPRAFSPEHGPAKQNGQKSRTNKMPPHPLAYTSTTNFKGWDPNEQSLRRQAYSNKGKLGTAETGSSDPLGTRPQHYPPPQPYFITNSKTEVTV

SEQ ID NO: 63451 - protein, 225 aa, Homo sapiens
MEELTAFVSKSFDQKSKDGNGGGGGGGGKKDSITYREVLESGLARSRELGTSDSSLQDITEGGGHCPVHLFKDHVDNDKEKLKEFGTARVAEGIYECKEKREDVKSEDEDGQTKLKQRRSRTNFTLEQLNELERLFDETHYPDAFMREELSQRLGLSEARVQVWFQNRRAKCRKQENQMHKGVILGTANHLDACRVAPYVNMGALRMPFQQMEFCSCRPGWSIMA

SEQ ID NO: 63452 - protein, 225 aa, Homo sapiens; identical to SEQ ID NO: 63451

SEQ ID NO: 63453 - protein, 292 aa, Homo sapiens
MEELTAFVSKSFDQKSKDGNGGGGGGGGKKDSITYREVLESGLARSRELGTSDSSLQDITEGGGHCPVHLFKDHVDNDKEKLKEFGTARVAEGIYECKEKREDVKSEDEDGQTKLKQRRSRTNFTLEQLNELERLFDETHYPDAFMREELSQRLGLSEARVQVWFQNRRAKCRKQENQMHKGVILGTANHLDACRVAPYVNMGALRMPFQQVQAQLQLEGVAHAHPHLHPHLAAHAPYLMFPPPPFGLPIASLAESASAAAVVAAAAKSNSKNSSIADLRLKARKHAEALGL

SEQ ID NO: 63454 - protein, 292 aa, Homo sapiens; identical to SEQ ID NO: 63453

SEQ ID NO: 63455 - protein, 190 aa, Homo sapiens
MEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 63456 - protein, 331 aa, Homo sapiens
MEELTAFVSKSFDQKVKEKKEAITYREVLESGPLRGAKEPTGCTEAGRDDRSSPAVRAAGGGGGGGGGGGGGGGGGGVGGGGAGGGAGGGRSPVRELDMGAAERSREPGSPRLTEVSPELKDRKEDAKGMEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQDSHCNVTPLSFQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 63457 - protein, 355 aa, Homo sapiens
MEELTAFVSKSFDQKVKEKKEAITYREVLESGPLRGAKEPTGCTEAGRDDRSSPAVRAAGGGGGGGGGGGGGGGGGGVGGGGAGGGAGGGRSPVRELDMGAAERSREPGSPRLTEGRRKPTKAEVQATLLLPGEAFRFLVSPELKDRKEDAKGMEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQDSHCNVTPLSFQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 63458 - protein, 190 aa, Homo sapiens; identical to SEQ ID NO: 63455

SEQ ID NO: 63459 - protein, 190 aa, Homo sapiens; identical to SEQ ID NO: 63455

SEQ ID NO: 63460 - protein, 577 aa, Homo sapiens
MLTPAFDLSQDPDFLTIAIRVPYARVSEFDVYFEGSDFKFYAKPYFLRLTLPGRIVENGSEQGSYDADKGIFTIRLPKETPGQHFEGLNMLTALLAPRKSRTAKPLVEEIGASEIPEEVVDDEEFDWEIEQTPCEEVSESALNPQCHYGFGNLRSGVLQRLQDELSDVIDIKDPDFTPAAERRQKRLAAELAKFDPDHYLADFFEDEAIEQILKYNPWWTDKYSKMMAFLEKSQEQENHATLVSFSEEEKYQLRKFVNKSYLLDKRACRQVCYSLIDILLAYCYETRVTEGEKNVESAWNIRKLSPTLCWFETWTNVHDIMVSFGRRVLCYPLYRHFKLVMKAYRDTIKILQLGKSAVLKCLLDIHKIFQENDPAYILNDLYISDYCVWIQKVKSKKLAALAEALKEVSLTKAQLGLELEELEAAALLVQEEETALKAAHSVSGQQTLCSSSEASDSEDSDSSVSSGNEDSGSDSEQDELKDSPSETVSSLQGPFLEESSAFLIVDGGVRRNTAIQESDASQGKPLASSWPLGVSGPLIEELGEQLKTTVQVSEPKGTTAVNRSNIQERDGCQTPNN

SEQ ID NO: 63461 - protein, 1616 aa, Homo sapiens
MEGAEPRARPERLAEAETRAADGGRLVEVQLSGGAPWGFTLKGGREHGEPLVITKIEEGSKAAAVDKLLAGDEIVGINDIGLSGFRQEAICLVKGSHKTLKLVVKRRSELGWRPHSWHATKFSDSHPELAASPFTSTSGCPSWSGRHHASSSSHDLSSSWEQTNLQRTLDHFSSLGSVDSLDHPSSRLSVAKSNSSIDHLGSHSKRDSAYGSFSTSSSTPDHTLSKADTSSAENILYTVGLWEAPRQGGRQAQAAGDPQGSEEKLSCFPPRVPGDSGKGPRPEYNAEPKLAAPGRSNFGPVWYVPDKKKAPSSPPPPPPPLRSDSFAATKSHEKAQGPVFSEAAAAQHFTALAQAQPRGDRRPELTDRPWRSAHPGSLGKGSGGPGCPQEAHADGSWPPSKDGASSRLQASLSSSDVRFPQSPHSGRHPPLYSDHSPLCADSLGQEPGAASFQNDSPPQVRGLSSCDQKLGSGWQGPRPCVQGDLQAAQLWAGCWPSDTALGALESLPPPTVGQSPRHHLPQPEGPPDARETGRCYPLDKGAEGCSAGAQEPPRASRAEKASQRLAASITWADGESSRICPQETPLLHSLTQEGKRRPESSPEDSATRPPPFDAHVGKPTRRSDRFATTLRNEIQMHRAKLQKSRSTVALTAAGEAEDGTGRWRAGLGGGTQEGPLAGTYKDHLKEAQARVLRATSFKRRDLDPNPGDLYPESLEHRMGDPDTVPHFWEAGLAQPPSSTSGGPHPPRIGGRRRFTAEQKLKSYSEPEKMNEVGLTRGYSPHQHPRTSEDTVGTFADRWKFFEETSKPVPQRPAQKQALHGIPRDKPERPRTAGRTCEGTEPWSRTTSLGDSLNAHSAAEKAGTSDLPRRLGTFAEYQASWKEQRKPLEARSSGRCHSADDILDVSLDPQERPQHVHGRSRSSPSTDHYKQEASVELRRQAGDPGEPREELPSAVRAEEGQSTPRQADAQCREGSPGSQQHPPSQKAPNPPTFSELSHCRGAPELPREGRGRAGTLPRDYRYSEESTPADLGPRAQSPGSPLHARGQDSWPVSSALLSKRPAPQRPPPPKREPRRYRATDGAPADAPVGVLGRPFPTPSPASLDVYVARLSLSHSPSVFSSAQPQDTPKATVCERGSQHVSGDASRPLPEALLPPKQQHLRLQTATMETSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKAKEKTVEDLKSEELAREIVGKDKSLADILDPSVKIKTTMDLMEGIFPKDEHLLEEAQQRRKLLPKIPSPRSTEERKEEPSVPAAVSLATNSTYYSTSAPKAELLIKMKDLQEQQEHEEDSGSDLDHDLSVKKQELIESISRKLQVLREARESLLEDVQANTVLGAEVEAIVKGVCKPSEFDKFRMFIGDLDKVVNLLLSLSGRLARVENALNNLDDGASPGDRQSLLEKQRVLIQQHEDAKELKENLDRRERIVFDILANYLSEESLADYEHFVKMKSALIIEQRELEDKIHLGEEQLKCLLDSLQPERGK

SEQ ID NO: 63462 - protein, 451 aa, Homo sapiens
METSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKAKEKTVEDLKSEELAREIVGKDKSLADILDPSVKIKTTMDLMEGIFPKDEHLLEEAQQRRKLLPKIPSPRSTEERKEEPSVPAAVSLATNSTYYSTSAPKAELLIKMKDLQEQQEHEEDSGSDLDHDLSVKKQELIESISRKLQVLREARESLLEDVQANTVLGAEVEAIVKGVCKPSEFDKFRMFIGDLDKVVNLLLSLSGRLARVENALNNLDDGASPGDRQSLLEKQRVLIQQHEDAKELKENLDRRERIVFDILANYLSEESLADYEHFVKMKSALIIEQRELEDKIHLGEEQLKCLLDSLQPERGK

SEQ ID NO: 63463 - protein, 375 aa, Homo sapiens
METSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKAKEKTVEDLKSEELAREIVGKDKSLADILDPSVKIKTTMDLMEGIFPKDEHLLEEAQQRRKLLPKIPSPRSTEERKEEPSVPAAVSLATNSTYYSTSAPKAELLIKMKDLQEQQEHEEDSGSDLDHDLSVKKQELIESISRKLQVLREARESLLEDVQANTVLGAEVEAIVKGVCKPSEFDKFRMFIGDLDKVVNLLLSLSGRLARVENALNNLDDGASPGDRQSLLEKQRVLIQ

SEQ ID NO: 63464 - protein, 400 aa, Homo sapiens
METSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKAKEKTVEDLKSEELAREIVGKDKSLADILDPSVKIKTTMDLMEGIFPKDEHLLEEAQQRRKLLPKIPSPRSTEERKEEPSVPAAVSLATNSTYYSTSAPKAELLIKMKDLQEQQEHEEDSGSDLDHDLSVKKQELIESISRKLQVLREARESLLEDVQANTVLGAEVEAIVKGVCKPSEFDKFRMFIGDLDKVVNLLLSLSGRLARVENALNNLDDGASPGDRQSLLEKQRVLIQQMCVDFMLDTYHSPINRSSCLTVTK

SEQ ID NO: 63465 - protein, 258 aa, Homo sapiens [sequence omitted]

SEQ ID NO: 63466 - protein, 1996 aa, Homo sapiens
MMRTTEDFHKPSATLNSNTATKGRYIYLEAFLEGGAPWGFTLKGGLEHGEPLIISKVEEGGKADTLSSKLQAGDEVVHINEVTLSSSRKEAVSLVKGSYKTLRLVVRRDVCTDPGHADTGASNFVSPEHLTSGPQHRKAAWSGGVKLRLKHRRSEPAGRPHSWHTTKSGEKQPDASMMQISQGMIGPPWHQSYHSSSSTSDLSNYDHAYLRRSPDQCSSQGSMESLEPSGAYPPCHLSPAKSTGSIDQLSHFHNKRDSAYSSFSTSSSILEYPHPGISGRERSGSMDNTSARGGLLEGMRQADIRYVKTVYDTRRGVSAEYEVNSSALLLQGREARASANGQGYDKWSNIPRGKGVPPPSWSQQCPSSLETATDNLPPKVGAPLPPARSDSYAAFRHRERPSSWSSLDQKRLCRPQANSLGSLKSPFIEEQLHTVLEKSPENSPPVKPKHNYTQKAQPGQPLLPTSIYPVPSLEPHFAQVPQPSVSSNGMLYPALAKESGYIAPQGACNKMATIDENGNQNGSGRPGFAFCQPLEHDLLSPVEKKPEATAKYVPSKVHFCSVPENEEDASLKRHLTPPQGNSPHSNERKSTHSNKPSSHPHSLKCPQAQAWQAGEDKRSSRLSEPWEGDFQEDHNANLWRRLEREGLGQSLSGNFGKTKSAFSSLQNIPESLRRHSSLELGRGTQEGYPGGRPTCAVNTKAEDPGRKAAPDLGSHLDRQVSYPRPEGRTGASASFNSTDPSPEEPPAPSHPHTSSLGRRGPGPGSASALQGFQYGKPHCSVLEKVSKFEQREQGSQRPSVGGSGFGHNYRPHRTVSTSSTSGNDFEETKAHIRFSESAEPLGNGEQHFKNGELKLEEASRQPCGQQLSGGASDSGRGPQRPDARLLRSQSTFQLSSEPEREPEWRDRPGSPESPLLDAPFSRAYRNSIKDAQSRVLGATSFRRRDLELGAPVASRSWRPRPSSAHVGLRSPEASASASPHTPRERHSVTPAEGDLARPVPPAARRGARRRLTPEQKKRSYSEPEKMNEVGIVEEAEPAPLGPQRNGMRFPESSVADRRRLFERDGKACSTLSLSGPELKQFQQSALADYIQRKTGKRPTSAAGCSLQEPGPLRERAQSAYLQPGPAALEGSGLASASSLSSLREPSLQPRREATLLPATVAETQQAPRDRSSSFAGGRRLGERRRGDLLSGANGGTRGTQRGDETPREPSSWGARAGKSMSAEDLLERSDVLAGPVHVRSRSSPATADKRQDVLLGQDSGFGLVKDPCYLAGPGSRSLSCSERGQEEMLPLFHHLTPRWGGSGCKAIGDSSVPSECPGTLDHQRQASRTPCPRPPLAGTQGLVTDTRAAPLTPIGTPLPSAIPSGYCSQDGQTGRQPLPPYTPAMMHRSNGHTLTQPPGPRGCEGDGPEHGVEEGTRKRVSLPQWPPPSRAKWAHAAREDSLPEESSAPDFANLKHYQKQQSLPSLCSTSDPDTPLGAPSTPGRISLRISESVLRDSPPPHEDYEDEVFVRDPHPKATSSPTFEPLPPPPPPPPSQETPVYSMDDFPPPPPHTVCEAQLDSEDPEGPRPSFNKLSKVTIARERHMPGAAHVVGSQTLASRLQTSIKGSEAESTPPSFMSVHAQLAGSLGGQPAPIQTQSLSHDPVSGTQGLEKKVSPDPQKSSEDIRTEALAKEIVHQDKSLADILDPDSRLKTTMDLMEGLFPRDVNLLKENSVKRKAIQRTVSSSGCEGKRNEDKEAVSMLVNCPAYYSVSAPKAELLNKIKEMPAEVNEEEEQADVNEKKAELIGSLTHKLETLQEAKGSLLTDIKLNNALGEEVEALISELCKPNEFDKYRMFIGDLDKVVNLLLSLSGRLARVENVLSGLGEDASNEERSSLYEKRKILAGQHEDARELKENLDRRERVVLGILANYLSEEQLQDYQHFVKMKSTLLIEQRKLDDKIKLGQEQVKCLLESLPSDFIPKAGALALPPNLTSEPIPAGGCTFSGIFPTLTSPL

SEQ ID NO: 63467 - protein, 186 aa, Homo sapiens
MAFYSTTEYDIQLARGLLSGMFLFATRRSEPAGRPHSWHTTKSGEKQPDASMMQISQGMIGPPWHQSYHSSSSTSDLSNYDHAYLRRSPDQCSSQGSMESLEPSGAYPPCHLSPAKSTGSIDQLSHFHNKRDSAYSSFSTSSSILEYPHPGKRVKTRDLPGSQSPGRAISRKTTMPTSGGGWREKA

SEQ ID NO: 63468 - protein, 1493 aa, Homo sapiens
MENRPGSFQYVPVQLQGGAPWGFTLKGGLEHCEPLTVSKIEDGGKAALSQKMRTGDELVNINGTPLYGSRQEALILIKGSFRILKLIVRRRNAPVSRPHSWHVAKLLEGCPEAATTMHFPSEAFSLSWHSGCNTSDVCVQWCPLSRHCSTEKSSSIGSMESLEQPGQATYESHLLPIDQNMYPNQRDSAYSSFSASSNASDCALSLRPEEPASTDCIMQGPGPTKAPSGRPNVAETSGGSRRTNGGHLTPSSQMSSRPQEGYQSGPAKAVRGPPQPPVRRDSLQASRAQLLNGEQRRASEPVVPLPQKEKLSLEPVLPARNPNRFCCLSGHDQVTSEGHQNCEFSQPPESSQQGSEHLLMQASTKAVGSPKACDRASSVDSNPLNEASAELAKASFGRPPHLIGPTGHRHSAPEQLLASHLQHVHLDTRGSKGMELPPVQDGHQWTLSPLHSSHKGKKSPCPPTGGTHDQSSKERKTRQVDDRSLVLGHQSQSSPPHGEADGHPSEKGFLDPNRTSRAASELANQQPSASGSLVQQATDCSSTTKAASGTEAGEEGDSEPKECSRMGGRRSGGTRGRSIQNRRKSERFATNLRNEIQRRKAQLQKSKGPLSQLCDTKEPVEETQEPPESPPLTASNTSLLSSCKKPPSPRDKLFNKSMMLRARSSECLSQAPESHESRTGLEGRISPGQRPGQSSLGLNTWWKAPDPSSSDPEKAHAHCGVRGGHWRWSPEHNSQPLVAAAMEGPSNPGDNKELKASTAQAGEDAILLPFADRRKFFEESSKSLSTSHLPGLTTHSNKTFTQRPKPIDQNFQPMSSSCRELRRHPMDQSYHSADQPYHATDQSYHSMSPLQSETPTYSECFASKGLENSMCCKPLHCGDFDYHRTCSYSCSVQGALVHDPCIYCSGEICPALLKRNMMPNCYNCRCHHHQCIRCSVCYHNPQHSALEDSSLAPGNTWKPRKLTVQEFPGDKWNPITGNRKTSQSGREMAHSKTSFSWATPFHPCLENPALDLSSYRAISSLDLLGDFKHALKKSEETSVYEEGSSLASMPHPLRSRAFSESHISLAPQSTRAWGQHRRELFSKGDETQSDLLGARKKAFPPPRPPPPNWEKYRLFRAAQQQKQQQQQQKQQEEEEEEEEEEEEEEEEEEEEAEEEEEELPPQYFSSETSGSCALNPEEVLEQPQPLSFGHLEGSRQGSQSVPAEQESFALHSSDFLPPIRGHLGSQPEQAQPPCYYGIGGLWRTSGQEATESAKQEFQHFSPPSGAPGIPTSYSAYYNISVAKAELLNKLKDQPEMAEIGLGEEEVDHELAQKKIQLIESISRKLSVLREAQRGLLEDINANSALGEEVEANLKAVCKSNEFEKYHLFVGDLDKVVNLLLSLSGRLARVENALNSIDSEANQEKLVLIEKKQQLTGQLADAKELKEHVDRREKLVFGMVSRYLPQDQLQDYQHFVKMKSALIIEQRELEEKIKLGEEQLKCLRESLLLGPSNF

SEQ ID NO: 63469 - protein, 1493 aa, Homo sapiens; identical to SEQ ID NO: 63468

SEQ ID NO: 63470 - protein, 1377 aa, Homo sapiens
MHFPSEAFSLSWHSGCNTSDVCVQWCPLSRHCSTEKSSSIGSMESLEQPGQATYESHLLPIDQNMYPNQRDSAYSSFSASSNASDCALSLRPEEPASTDCIMQGPGPTKAPSGRPNVAETSGGSRRTNGGHLTPSSQMSSRPQEGYQSGPAKAVRGPPQPPVRRDSLQASRAQLLNGEQRRASEPVVPLPQKEKLSLEPVLPARNPNRFCCLSGHDQVTSEGHQNCEFSQPPESSQQGSEHLLMQASTKAVGSPKACDRASSVDSNPLNEASAELAKASFGRPPHLIGPTGHRHSAPEQLLASHLQHVHLDTRGSKGMELPPVQDGHQWTLSPLHSSHKGKKSPCPPTGGTHDQSSKERKTRQVDDRSLVLGHQSQSSPPHGEADGHPSEKGFLDPNRTSRAASELANQQPSASGSLVQQATDCSSTTKAASGTEAGEEGDSEPKECSRMGGRRSGGTRGRSIQNRRKSERFATNLRNEIQRRKAQLQKSKGPLSQLCDTKEPVEETQEPPESPPLTASNTSLLSSCKKPPSPRDKLFNKSMMLRARSSECLSQAPESHESRTGLEGRISPGQRPGQSSLGLNTWWKAPDPSSSDPEKAHAHCGVRGGHWRWSPEHNSQPLVAAAMEGPSNPGDNKELKASTAQAGEDAILLPFADRRKFFEESSKSLSTSHLPGLTTHSNKTFTQRPKPIDQNFQPMSSSCRELRRHPMDQSYHSADQPYHATDQSYHSMSPLQSETPTYSECFASKGLENSMCCKPLHCGDFDYHRTCSYSCSVQGALVHDPCIYCSGEICPALLKRNMMPNCYNCRCHHHQCIRCSVCYHNPQHSALEDSSLAPGNTWKPRKLTVQEFPGDKWNPITGNRKTSQSGREMAHSKTSFSWATPFHPCLENPALDLSSYRAISSLDLLGDFKHALKKSEETSVYEEGSSLASMPHPLRSRAFSESHISLAPQSTRAWGQHRRELFSKGDETQSDLLGARKKAFPPPRPPPPNWEKYRLFRAAQQQKQQQQQQKQQEEEEEEEEEEEEEEEEEEEEAEEEEEELPPQYFSSETSGSCALNPEEVLEQPQPLSFGHLEGSRQGSQSVPAEQESFALHSSDFLPPIRGHLGSQPEQAQPPCYYGIGGLWRTSGQEATESAKQEFQHFSPPSGAPGIPTSYSAYYNISVAKAELLNKLKDQPEMAEIGLGEEEVDHELAQKKIQLIESISRKLSVLREAQRGLLEDINANSALGEEVEANLKAVCKSNEFEKYHLFVGDLDKVVNLLLSLSGRLARVENALNSIDSEANQEKLVLIEKKQQLTGQLADAKELKEHVDRREKLVFGMVSRYLPQDQLQDYQHFVKMKSALIIEQRELEEKIKLGEEQLKCLRESLLLGPSNF

SEQ ID NO: 63471 - protein, 561 aa, Homo sapiens
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEDQIPTIPQDTLGVDFDSGEAKSTDNVLPRTVSVRSSLKKHCNSICQFDSLDDFETSHLAGKSFEFERVGFLDPLVNMHIPENVQHNACQWSKDQVNLSPKLIQPGTFTKTKEDILESKSEQTKSKQRDTQERKREEKRKANRRKSKRMSKYKENKSENKKTVPQKKMHKSVSSNDAYNFNLEEGVHLTPFRQKVSNDSNREENNESEVSLCESSGSGDDSDDLYLPTCKYIQNPTSNSDRPVTRPLAKRALKYTDEKETEGSKPTKTPTTTPPETQQSPHLSLKDITNVSLYPVVKIRRLSLSPKKNKASPAVALPKRRCTASVNYKEPTLASKLRRGDPFTDLCFLNSPIFKQKKDLRRSKKRALEVSPAKEAIFILYYVREFVSRFPDCRKCKLETHICLR

SEQ ID NO: 63472 - protein, 292 aa, Homo sapiens
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEATPPETQQSPHLSLKDITNVSLYPVVKIRRLSLSPKKNKASPAVALPKRRCTASVNYKEPTLASKLRRGDPFTDLCFLNSPIFKQKKDLRRSKKRALEVSPAKEAIFILYYVREFVSRFPDCRKCKLETHICLR

SEQ ID NO: 63473 - protein, 215 aa, Homo sapiens
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEDQIPTIPQDTLGVDFDSGALEVSPAKEAIFILYYVREFVSRFPDCRKCKLETHICLR

SEQ ID NO: 63474 - protein, 527 aa, Homo sapiens
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEDQIPTIPQDTLGVDFDSGEAKSTDNVLPRTVSVRSSLKKHCNSICQFDSLDDFETSHLAGKSFEFERVGFLDPLVNMHIPENVQHNACQWSKDQVNLSPKLIQPGTFTKTKEDILESKSEQTKSKQRDTQERKREEKRKANRRKSKRMSKYKENKSENKKTVPQKKMHKSVSSNDAYNFNLEEGVHLTPFRQKVSNDSNREENNESEVSLCESSGSGDDSDDLYLPTCKYIQNPTSNSDRPVTRPLAKRALKYTDEKETEGSKPTKTPTTTPPETQQSPHLSLKDITNVSLYPVVKIRRLSLSPKKNKASPAVALPKRRCTASVNYKEPTLASKLRRGDPFTDLCFLNSPIFKQKKDLRRSKKSMKQIQ

SEQ ID NO: 63475 - protein, 527 aa, Homo sapiens; identical to SEQ ID NO: 63474

SEQ ID NO: 63476 - protein, 275 aa, Homo sapiens
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEDQIPTIPQDTLGVDFDSATPPETQQSPHLSLKDITNVSLYPVVKIRRLSLSPKKNKASPAVALPKRRCTASVNYKEPTLASKLRRGDPFTDLCFLNSPIFKQKKDLRRSKKSMKQIQ

SEQ ID NO: 63477 - protein, 309 aa, Homo sapiens
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEDQIPTIPQDTLGVDFDSATPPETQQSPHLSLKDITNVSLYPVVKIRRLSLSPKKNKASPAVALPKRRCTASVNYKEPTLASKLRRGDPFTDLCFLNSPIFKQKKDLRRSKKRALEVSPAKEAIFILYYVREFVSRFPDCRKCKLETHICLR

SEQ ID NO: 63478 - protein, 561 aa, Homo sapiens; identical to SEQ ID NO: 63471

SEQ ID NO: 63479 - protein, 309 aa, Homo sapiens; identical to SEQ ID NO: 63477

SEQ ID NO: 63480 - protein, 258 aa, Homo sapiens
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEATPPETQQSPHLSLKDITNVSLYPVVKIRRLSLSPKKNKASPAVALPKRRCTASVNYKEPTLASKLRRGDPFTDLCFLNSPIFKQKKDLRRSKKSMKQIQ

SEQ ID NO: 63481 - protein, 275 aa, Homo sapiens; identical to SEQ ID NO: 63476

SEQ ID NO: 63482 - protein, 258 aa, Homo sapiens; identical to SEQ ID NO: 63480

SEQ ID NO: 63483 - protein, 292 aa, Homo sapiens; identical to SEQ ID NO: 63472

SEQ ID NO: 63484 - protein, 1265 aa, Homo sapiens
MECPVMETGSLFTSGIKRHLKDKRISKTTKLNVSLASKIKTKILNNSSIFKISLKHNNRALAQALSREKENSRRITTEKMLLQKEVEKLNFENTFLRLKLNNLNKKLIDIEALMNNNLITAIEMSSLSEFHQSSFLLSASKKKRISKQCKLMRLPFARVPLTSNDDEDEDKEKMQCDNNIKSKTLPDIPSSGSTTQPLSTQDNSEVLFLKENNQNVYGLDDSEHISSIVDVPPRESHSHSDQSSKTSLMSEMRNAQSIGRRWEKPSPSNVTERKKRGSSWESNNLSADTPCATVLDKQHISSPELNCNNEINGHTNETNTEMQRNKQDLPGLSSESAREPNAECMNQIEDNDDFQLQKTVYDADMDLTASEVSKIVTVSTGIKKKSNKKTNEHGMKTFRKVKDSSSEKKRERSKRQFKNSSDVDIGEKIENRTERSDVLDGKRGAEDPGFIFNNEQLAQMNEQLAQVNELKKMTLQTGFEQGDRENVLCNKKEKRITNEQEETYSLSQSSGKFHQESKFDKGQNSLTCNKSKASRQTFVIHKLEKDNLLPNQKDKVTIYENLDVTNEFHTANLSTKDNGNLCDYGTHNILDLKKYVTDIQPSEQNESNINKLRKKVNRKTEIISGMNHMYEDNDKDVVHGLKKGNFFFKTQEDKEPISENIEVSKELQIPALSTRDNENQCDYRTQNVLGLQKQITNMYPVQQNESKVNKKLRQKVNRKTEIISEVNHLDNDKSIEYTVKSHSLFLTQKDKEIIPGNLEDPSEFETPALSTKDSGNLYDSEIQNVLGVKHGHDMQPACQNDSKIGKKPRLNVCQKSEIIPETNQIYENDNKGVHDLEKDNFFSLTPKDKETISENLQVTNEFQTVDLLIKDNGNLCDYDTQNILELKKYVTDRKSAEQNESKINKLRNKVNWKTEIISEMNQIYEDNDKDAHVQESYTKDLDFKVNKSKQKLECQDIINKHYMEVNSNEKESCDQILDSYKVVKKRKKESSCKAKNILTKAKNKLASQLTESSQTSISLESDLKHITSEADSDPGNPVELCKTQKQSTTTLNKKDLPFVEEIKEGECQVKKVNKMTSKSKKRKTSIDPSPESHEVMERILDSVQGKSTVSEQADKENNLENEKMVKNKPDFYTKAFRSLSEIHSPNIQDSSFDSVREGLVPLSVSSGKNVIIKENFALECSPAFQVSDDEHEKMNKMKFKVNRRTQKSGIGDRPLQDLSNTSFVSNNTAESENKSEDLSSERTSRRRRCTPFYFKEPSLRDKMRR

SEQ ID NO: 63485 - protein, 247 aa, Homo sapiens
MECPVMETGSLFTSGIKRHLKDKRISKTTKLNVSLASKIKTKILNNSSIFKISLKHNNRALAQALSREKENSRRITTEKMLLQKEVEKLNFENTFLRLKLNNLNKKLIDIEALMNNNLITAIEMSSLSEFHQSSFLLSASKKKRISKQCKLMRLPFARVPLTSNDDEDEDKEKMQCDNNIKSKTLPDIPSSGSTTQPLSTQDNSEVLFLKENNQNVYGLDDSEHISSIVDVPPRGEIVLKIHFEYLY

SEQ ID NO: 63486 - protein, 87 aa, Homo sapiens
MECPVMETGSLFTSGIKRHLKDKRISKTTKLNVSLASKIKTKILNNSSIFKISLKHNNRALAQALSREKENSRRITTEKMLLQKEVE

SEQ ID NO: 63487 - protein, 250 aa, Homo sapiens
MSIFTPTNQIRLTNVAVVRMKRAGKRFEIACYKNKVVGWRSGVEKDLDEVLQTHSVFVNVSKGQVAKKEDLISAFGTDDQTEICKQILTKGEVQVSDKERHTQLEQMFRDIATIVADKCVNPETKRPYTVILIERAMKDIHYSVKTNKSTKQQALEVIKQLKEKMKIERAHMRLRFILPVNEGKKLKEKLKPLIKVIESEDYGQQLEIVCLIDPGCFREIDELIKKETKGKGSLEVLNLKDVEEGDEKFE

SEQ ID NO: 63488 - protein, 523 aa, Homo sapiens
MVAPGLVLGLVLPLILWADRSAGIGFRFASYINNDMVLQKEPAGAVIWGFGTPGATVTVTLRQGQETIMKKVTSVKAHSDTWMVVLDPMKPGGPFEVMAQQTLEKINFTLRVHDVLFGDVWLCSGQSNMQMTVLQIFNATRELSNTAAYQSVRILSVSPIQAEQELEDLVAVDLQWSKPTSENLGHGYFKYMSAVCWLFGRHLYDTLQYPIGLIASSWGGTPIEAWSSGRSLKACGVPKQGSIPYDSVTGPSKHSVLWNAMIHPLCNMTLKGVVWYQGESNINYNTDLYNCTFPALIEDWRETFHRGSQGQTERFFPFGLVQLSSDLSKKSSDDGFPQIRWHQTADFGYVPNPKMPNTFMAVAMDLCDRDSPFGSIHPRDKQTVAYRLHLGARALAYGEKNLTFEGPLPEKIELLAHKGLLNLTYYQQIQVQKKDNKIFEISCCSDHRCKWLPASMNTVSTQSLTLAIDSCHGTVVALRYAWTTWPCEYKQCPLYHPSSALPAPPFIAFITDQGPGHQSNVAK

SEQ ID NO: 63489 - protein, 488 aa, Homo sapiens
MVLQKEPAGAVIWGFGTPGATVTVTLRQGQETIMKKVTSVKAHSDTWMVVLDPMKPGGPFEVMAQQTLEKINFTLRVHDVLFGDVWLCSGQSNMQMTVLQIFNATRELSNTAAYQSVRILSVSPIQAEQELEDLVAVDLQWSKPTSENLGHGYFKYMSAVCWLFGRHLYDTLQYPIGLIASSWGGTPIEAWSSGRSLKACGVPKQGSIPYDSVTGPSKHSVLWNAMIHPLCNMTLKGVVWYQGESNINYNTDLYNCTFPALIEDWRETFHRGSQGQTERFFPFGLVQLSSDLSKKSSDDGFPQIRWHQTADFGYVPNPKMPNTFMAVAMDLCDRDSPFGSIHPRDKQTVAYRLHLGARALAYGEKNLTFEGPLPEKIELLAHKGLLNLTYYQQIQVQKKDNKIFEISCCSDHRCKWLPASMNTVSTQSLTLAIDSCHGTVVALRYAWTTWPCEYKQCPLYHPSSALPAPPFIAFITDQGPGHQSNVAK

SEQ ID NO: 63490 - protein, 697 aa, Homo sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 63491 - protein, 602 aa, Homo sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 63492 - protein, 697 aa, Homo sapiens; identical to SEQ ID NO: 63490

SEQ ID NO: 63493 - protein, 519 aa, Homo sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 63494 - protein, 639 aa, Homo sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 63495 - protein, 544 aa, Homo sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 63496 - protein, 454 aa, Homo sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTVLSFTPRPQDHNTDLTCHVDFSRKGVSAQRTVRLRVAYAPRDLVISISRDNTPDPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 63497 - protein, 554 aa, Homo sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTGTKPTTSHFSVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 63498 - protein, 698 aa, Homo sapiens
MVPGQAQPQSPEMLLLPLLLPVLGAGSLNKDPSYSLQVQRQVPVPEGLCVIVSCNLSYPRDGWDESTAAYGYWFKGRTSPKTGAPVATNNQSREVEMSTRDRFQLTGDPGKGSCSLVIRDAQREDEAWYFFRVERGSRVRHSFLSNAFFLKVTALTKKPDVYIPETLEPGQPVTVICVFNWAFKKCPAPSFSWTGAALSPRRTRPSTSHFSVLSFTPSPQDHDTDLTCHVDFSRKGVSAQRTVRLRVAYAPKDLIISISHDNTSALELQGNVIYLEVQKGQFLRLLCAADSQPPATLSWVLQDRVLSSSHPWGPRTLGLELRGVRAGDSGRYTCRAENRLGSQQQALDLSVQYPPENLRVMVSQANRTVLENLGNGTSLPVLEGQSLRLVCVTHSSPPARLSWTRWGQTVGPSQPSDPGVLELPPIQMEHEGEFTCHAQHPLGSQHVSLSLSVHYPPQLLGPSCSWEAEGLHCSCSSQASPAPSLRWWLGEELLEGNSSQGSFEVTPSSAGPWANSSLSLHGGLSSGLRLRCKAWNVHGAQSGSVFQLLPGKLEHGGGLGLGAALGAGVAALLAFCSCLVVFRVKICRKEARKRAAAEQDVPSTLGPISQGHQHECSAGSSQDHPPPGAATYTPGKGEEQELHYASLSFQGLRLWEPADQEAPSTTEYSEIKIHTGQPLRGPGFGLQLEREMSGMVPK

SEQ ID NO: 63499 - protein, 602 aa, Homo sapiens
MVPGQAQPQSPEMLLLPLLLPVLGAGSLNKDPSYSLQVQRQVPVPEGLCVIVSCNLSYPRDGWDESTAAYGYWFKGRTSPKTGAPVATNNQSREVEMSTRDRFQLTGDPGKGSCSLVIRDAQREDEAWYFFRVERGSRVRHSFLSNAFFLKVTALTKKPDVYIPETLEPGQPVTVICVFNWAFKKCPAPSFSWTGAALSPRRTRPSTSHFSVLSFTPSPQDHDTDLTCHVDFSRKGVSAQRTVRLRVAYAPKDLIISISHDNTSALELQGNVIYLEVQKGQFLRLLCAADSQPPATLSWVLQDRVLSSSHPWGPRTLGLELRGVRAGDSGRYTCRAENRLGSQQQALDLSVQYPPENLRVMVSQANRTVLENLGNGTSLPVLEGQSLRLVCVTHSSPPARLSWTRWGQTVGPSQPSDPGVLELPPIQMEHEGEFTCHAQHPLGSQHVSLSLSVHWKLEHGGGLGLGAALGAGVAALLAFCSCLVVFRVKICRKEARKRAAAEQDVPSTLGPISQGHQHECSAGSSQDHPPPGAATYTPGKGEEQELHYASLSFQGLRLWEPADQEAPSTTEYSEIKIHTGQPLRGPGFGLQLEREMSGMVPK

SEQ ID NO: 63500 - protein, 602 aa, Homo sapiens; identical to SEQ ID NO: 63499

SEQ ID NO: 63501 - protein, 595 aa, Homo sapiens
MLLLLLLLPPLLCGRVGAKEQKDYLLTMQKSVTVQEGLCVSVLCSFSYPQNGWTASDPVHGYWFRAGDHVSRNIPVATNNPARAVQEETRDRFHLLGDPQNKDCTLSIRDTRESDAGTYVFCVERGNMKWNYKYDQLSVNVTASQDLLSRYRLEVPESVTVQEGLCVSVPCSVLYPHYNWTASSPVYGSWFKEGADIPWDIPVATNTPSGKVQEDTHGRFLLLGDPQTNNCSLSIRDARKGDSGKYYFQVERGSRKWNYIYDKLSVHVTALTHMPTFSIPGTLESGHPRNLTCSVPWACEQGTPPTITWMGASVSSLDPTITRSSMLSLIPQPQDHGTSLTCQVTLPGAGVTMTRAVRLNISYPPQNLTMTVFQGDGTASTTLRNGSALSVLEGQSLHLVCAVDSNPPARLSWTWGSLTLSPSQSSNLGVLELPRVHVKDEGEFTCRAQNPLGSQHISLSLSLQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPK

SEQ ID NO: 63502 - protein, 551 aa, Homo sapiens
MLPLLLLPLLWGGSLQEKPVYELQVQKSVTVQEGLCVLVPCSFSYPWRSWYSSPPLYVYWFRDGEIPYYAEVVATNNPDRRVKPETQGRFRLLGDVQKKNCSLSIGDARMEDTGSYFFRVERGRDVKYSYQQNKLNLEVTALIEKPDIHFLEPLESGRPTRLSCSLPGSCEAGPPLTFSWTGNALSPLDPETTRSSELTLTPRPEDHGTNLTCQMKRQGAQVTTERTVQLNVSYAPQTITIFRNGIALEILQNTSYLPVLEGQALRLLCDAPSNPPAHLSWFQGSPALNATPISNTGILELRRVRSAEEGGFTCRAQHPLGFLQIFLNLSVYSLPQLLGPSCSWEAEGLHCRCSFRARPAPSLCWRLEEKPLEGNSSQGSFKVNSSSAGPWANSSLILHGGLSSDLKVSCKAWNIYGSQSGSVLLLQGRSNLGTGVVPAALGGAGVMALLCICLCLIFFLIVKARRKQAAGRPEKMDDEDPIMGTITSGSRKKPWPDSPGDQASPPGDAPPLEEQKELHYASLSFSEMKSREPKDQEAPSTTEYSEIKTSK

SEQ ID NO: 63503 - protein, 551 aa, Homo sapiens; identical to SEQ ID NO: 63502

SEQ ID NO: 63504 - protein, 353 aa, Homo sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWSSAPVPDRHSFRPPC

SEQ ID NO: 63505 - protein, 426 aa, Homo sapiens
MLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSSFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 63506 - protein, 437 aa, Homo sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSSFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 63507 - protein, 453 aa, Homo sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 63508 - protein, 389 aa, Homo sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSWMLRRPPLSTPDAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVISTSSRQA

SEQ ID NO: 63509 - protein, 401 aa, Homo sapiens
MQGAQEASASEMLPLLLPLLWAASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSSFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 63510 - protein, 374 aa, Homo sapiens
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTDPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPK

SEQ ID NO: 63511 - protein, 467 aa, Homo sapiens
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTALTHRPNILIPGTLESGCFQNLTCSVPWACEQGTPPMISWMGTSVSPLHPSTTRSSVLTLIPQPQHHGTSLTCQVTLPGAGVTTNRTIQLNVSYPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPK

SEQ ID NO: 63512 - protein, 145 aa, Homo sapiens
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTE

SEQ ID NO: 63513 - protein, 499 aa, Homo sapiens
MLLLLLLLPLLWGTKGMEGDRQYGDGYLLQVQELVTVQEGLCVHVPCSFSYPQDGWTDSDPVHGYWFRAGDRPYQDAPVATNNPDREVQAETQGRFQLLGDIWSNDCSLSIRDARKRDKGSYFFRLERGSMKWSYKSQLNYKTKQLSVFVTALTHRPDILILGTLESGHSRNLTCSVPWACKQGTPPMISWIGASVSSPGPTTARSSVLTLTPKPQDHGTSLTCQVTLPGTGVTTTSTVRLDVSYPPWNLTMTVFQGDATASTALGNGSSLSVLEGQSLRLVCAVNSNPPARLSWTRGSLTLCPSRSSNPGLLELPRVHVRDEGEFTCRAQNAQGSQHISLSLSLQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRG

SEQ ID NO: 63514 - protein, 406 aa, Homo sapiens
MLLLLLLLPLLWGTKGMEGDRQYGDGYLLQVQELVTVQEGLCVHVPCSFSYPQDGWTDSDPVHGYWFRAGDRPYQDAPVATNNPDREVQAETQGRFQLLGDIWSNDCSLSIRDARKRDKGSYFFRLERGSMKWSYKSQLNYKTKQLSVFVTDPPWNLTMTVFQGDATASTALGNGSSLSVLEGQSLRLVCAVNSNPPARLSWTRGSLTLCPSRSSNPGLLELPRVHVRDEGEFTCRAQNAQGSQHISLSLSLQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRG

SEQ ID NO: 63515 - protein, 390 aa, Homo sapiens
MLLLLLLLPLLWGTKGMEGDRQYGDGYLLQVQELVTVQEGLCVHVPCSFSYPQDGWTDSDPVHGYWFRAGDRPYQDAPVATNNPDREVQAETQGRFQLLGDIWSNDCSLSIRDARKRDKGSYFFRLERGSMKWSYKSQLNYKTKQLSVFVTASTALGNGSSLSVLEGQSLRLVCAVNSNPPARLSWTRGSLTLCPSRSSNPGLLELPRVHVRDEGEFTCRAQNAQGSQHISLSLSLQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRG

SEQ ID NO: 63516 - protein, 463 aa, Homo sapiens
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHR

SEQ ID NO: 63517 - protein, 479 aa, Homo sapiens
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQILNHFIGFPTFLGLGFEFLLNLRDLCCHPDSEFYVYHFSHFRLIKNIAGEIVWSLEGKILWLLDVSDFFHWFFLICVG

SEQ ID NO: 63518 - protein, 415 aa, Homo sapiens
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQPYELPDGSVVINARNQNNYHCHCRIVLRSYDACDTLRPRDVTFDPELVDPVVAAGAVVTSSGIVFFSNPAHPEFRVNLTLRWSFSNGTSWRKETVQLWPGPSGYSSLATLEGSMDGEEQAPQLYVLYEKGRNHYTESISVAKISVYGTL

SEQ ID NO: 63519 - protein, 415 aa, Homo sapiens; identical to SEQ ID NO: 63518

SEQ ID NO: 63520 - protein, 415 aa, Homo sapiens; identical to SEQ ID NO: 63518

SEQ ID NO: 63521 - protein, 415 aa, Homo sapiens; identical to SEQ ID NO: 63518

SEQ ID NO: 63522 - protein, 415 aa, Homo sapiens; identical to SEQ ID NO: 63518

SEQ ID NO: 63523 - protein, 415 aa, Homo sapiens; identical to SEQ ID NO: 63518

SEQ ID NO: 63524 - protein, 415 aa, Homo sapiens; identical to SEQ ID NO: 63518

SEQ ID NO: 63525 - protein, 415 aa, Homo sapiens; identical to SEQ ID NO: 63518

SEQ ID NO: 63526 - protein, 380 aa, Homo sapiens
MASLPVLQKESVFQSGAHAYRIPALLYLPGQQSLLAFAEQRASKKDEHAELIVLRRGDYDAPTHQVQWQAQEVVAQARLDGHRSMNPCPLYDAQTGTLFLFFIAIPGQVTEQQQLQTRANVTRLCQVTSTDHGRTWSSPRDLTDAAIGPAYREWSTFAVGPGHCLQLHDRARSLVVPAYAYRKLHPIQRPIPSAFCFLSHDHGRTWARGHFVAQDTLECQVAEVETGEQRVVTLNARSHLRARVQAQSTNDGLDFQESQLVKKLVEPPPQGCQGSVISFPSPRSGPGSPAQWLLYTHPTHSWQRADLGAYLNPRPPAPEAWSEPVLLAKGSCAYSDLQSMGTGPDGSPLFGCLYEANDYEEIVFLMFTLKQAFPAEYLPQ

SEQ ID NO: 63527 - protein, 461 aa, Homo sapiens
MRPADLPPRPMEESPASSSAPTETEEPGSSAEVMEEVTTCSFNSPLFRQEDDRGITYRIPALLYIPPTHTFLAFAEKRSTRRDEDALHLVLRRGLRIGQLVQWGPLKPLMEATLPGHRTMNPCPVWEQKSGCVFLFFICVRGHVTERQQIVSGRNAARLCFIYSQDAGCSWSEVRDLTEEVIGSELKHWATFAVGPGHGIQLQSGRLVIPAYTYYIPSWFFCFQLPCKTRPHSLMIYSDDLGVTWHHGRLIRPMVTVECEVAEVTGRAGHPVLYCSARTPNRCRAEALSTDHGEGFQRLALSRQLCEPPHGCQGSVVSFRPLEIPHRCQDSSSKDAPTIQQSSPGSSLRLEEEAGTPSESWLLYSHPTSRKQRVDLGIYLNQTPLEAACWSRPWILHCGPCGYSDLAALEEEGLFGCLFECGTKQECEQIAFRLFTHREILSHLQGDCTSPGRNPSQFKSN

SEQ ID NO: 63528 - protein, 461 aa, Homo sapiens; identical to SEQ ID NO: 63527

SEQ ID NO: 63529 - protein, 428 aa, Homo sapiens
MEEVTTCSFNSPLFRQEDDRGITYRIPALLYIPPTHTFLAFAEKRSTRRDEDALHLVLRRGLRIGQLVQWGPLKPLMEATLPGHRTMNPCPVWEQKSGCVFLFFICVRGHVTERQQIVSGRNAARLCFIYSQDAGCSWSEVRDLTEEVIGSELKHWATFAVGPGHGIQLQSGRLVIPAYTYYIPSWFFCFQLPCKTRPHSLMIYSDDLGVTWHHGRLIRPMVTVECEVAEVTGRAGHPVLYCSARTPNRCRAEALSTDHGEGFQRLALSRQLCEPPHGCQGSVVSFRPLEIPHRCQDSSSKDAPTIQQSSPGSSLRLEEEAGTPSESWLLYSHPTSRKQRVDLGIYLNQTPLEAACWSRPWILHCGPCGYSDLAALEEEGLFGCLFECGTKQECEQIAFRLFTHREILSHLQGDCTSPGRNPSQFKSN

SEQ ID NO: 63530 - protein, 352 aa, Homo sapiens
MEATLPGHRTMNPCPVWEQKSGCVFLFFICVRGHVTERQQIVSGRNAARLCFIYSQDAGCSWSEVRDLTEEVIGSELKHWATFAVGPGHGIQLQSGRLVIPAYTYYIPSWFFCFQLPCKTRPHSLMIYSDDLGVTWHHGRLIRPMVTVECEVAEVTGRAGHPVLYCSARTPNRCRAEALSTDHGEGFQRLALSRQLCEPPHGCQGSVVSFRPLEIPHRCQDSSSKDAPTIQQSSPGSSLRLEEEAGTPSESWLLYSHPTSRKQRVDLGIYLNQTPLEAACWSRPWILHCGPCGYSDLAALEEEGLFGCLFECGTKQECEQIAFRLFTHREILSHLQGDCTSPGRNPSQFKSN

SEQ ID NO: 63531 - protein, 400 aa, Homo sapiens
MATLLLLLGVLVVSPDALGSTTAVQTPTSGEPLVSTSEPLSSKMYTTSITSDPKADSTGDQTSALPPSTSINEGSPLWTSIGASTGSPLPEPTTYQEVSIKMSSVPQETPHATSHPAVPITANSLGSHTVTGGTITTNSPETSSRTSGAPVTTAASSLETSRGTSGPPLTMATVSLETSKGTSGPPVTMATDSLETSTGTTGPPVTMTTGSLEPSSGASGPQVSSVKLSTMMSPTTSTNASTVPFRNPDENSRGMLPVAVLVALLAVIVLVALLLLWRRRQKRRTGALVLSRGGKRNGVVDAWAGPAQVPEEGAVTVTVGGSGGDKGSGFPDGEGSSRRPTLTTFFGRRKSRQGSLAMEELKSGSGPSLKGEEEPLVASEDGAVDAPAPDEPEGGDGAAP

SEQ ID NO: 63532 - protein, 400 aa, Homo sapiens; identical to SEQ ID NO: 63531

SEQ ID NO: 63533 - protein, 355 aa, Homo sapiens
MATLLLLLGVLVVSPDALGSTTAVQTPTSGEPLVSTSEPLSSKMYTTSITSDPKADSTGDQTSALPPSTSINEGSPLWTSIGASTGSPLPEPTTYQEVSIKMSSVPQETPHATSHPAVPITANSLGSHTVTGGTITTNSPETSSRTSGAPVTTAASSLETSRGTSGPPLTMATVSLETSKGTSGPPVTMATDSLETSTGTTGPPVTMTTGSLEPSSGASGPQVSSVKLSTMMSPTTSTNASTVPFRNPDENSRGMLPVAVLVALLAVIVLVALLLLWRRRQKRRTGALVLSRGGKRNGVVDAWAGPAQVPEEGAVTVTVGGSGGDKGSGFPDGEGSSRRPTLTTFFGRRKSRQGS

SEQ ID NO: 63534 - protein, 223 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 63535 - protein, 189 aa, Homo sapiens
MQWAVGRRWAWAALLLAVAAVLTQVVWLWLGLDHELAFSRLIEELQWVFVNAGGWMGAMCLLHASLSEYVLLFGTALGSRGHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 63536 - protein, 134 aa, Homo sapiens
MGAMCLLHASLSEYVLLFGTALGSRGHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 63537 - protein, 192 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGETVVHGPGEATAVEWGPNTWMVEYGRGVIPSTLAFALADTVFSTQDFLTLFYTLRSYARGLRLELTTYLFGQDP

SEQ ID NO: 63538 - protein, 971 aa, Homo sapiens
MGVAGRNRPGAAWAVLLLLLLLPPLLLLAGAVPPGRGRAAGPQEDVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVEVKGLLPTSVSPRVSLHCGKSGGGDGCFLRCHSGIHLSSGLQGAYSVTCGSSSPLRNKQQKSNDSAFGDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRTLRKAVHREQFHLQLSGMNLDVAKKPPRTSERQAESCGVGQGHAENQCGLCQPGEYSADGFAPCHLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 63539 - protein, 347 aa, Homo sapiens
MGAAAVRWHLCVLLALGTRGRLAGGSGLPGSVDVDECSEGTDDCHIDAICQNTPKSYKCLCKPGYKGEGKQCEDIDECENDYYNGGCVHECINIPGNYRCTCFDGFMLAHDGHNCLDVDECQDNNGGCQQICVNAMGSYECQCHSGFFLSDNQHTCIHRSNEGMNCMNKDHGCAHICRETPKGGVACDCRPGFDLAQNQKDCTLTCNYGNGGCQHSCEDTDTGPTCGCHQKYALHSDGRTCIEKDEAAIERSQFNATSVADVDKRVKRRLLMETCAVNNGGCDRTCKDTATGVRCSCPVGFTLQPDGKTCKGQHVELCGCPCLYWPGQEPPCACIAGPRAGLNGGHV

SEQ ID NO: 63540 - protein, 988 aa, Homo sapiens
MGAAAVRWHLCVLLALGTRGRLAGGSGLPGSVDVDECSEGTDDCHIDAICQNTPKSYKCLCKPGYKGEGKQCEDIDECENDYYNGGCVHECINIPGNYRCTCFDGFMLAHDGHNCLDVDECQDNNGGCQQICVNAMGSYECQCHSGFFLSDNQHTCIHRSNEGMNCMNKDHGCAHICRETPKGGVACDCRPGFDLAQNQKDCTLTCNYGNGGCQHSCEDTDTGPTCGCHQKYALHSDGRTCIETCAVNNGGCDRTCKDTATGVRCSCPVGFTLQPDGKTCKDINECLVNNGGCDHFCRNTVGSFECGCRKGYKLLTDERTCQDIDECSFERTCDHICINSPGSFQCLCHRGYILYGTTHCGDVDECSMSNGSCDQGCVNTKGSYECVCPPGRRLHWNGKDCVETGKCLSRAKTSPRAQLSCSKAGGVESCFLSCPAHTLFVPDSENSYVLSCGVPGPQGKALQKRNGTSSGLGPSCSDAPTTPIKQKARFKIRDAKCHLRPHSQARAKETARQPLLDHCHVTFVTLKCDSSKKRRRGRKSPSKEVSHITAEFEIETKMEEASDTCEADCLRKRAEQSLQAAIKTLRKSIGRQQFYVQVSGTEYEVAQRPAKALEGQGACGAGQVLQDSKCVACGPGTHFGGELGQCVSCMPGTYQDMEGQLSCTPCPSSDGLGLPGARNVSECGGQCSPGFFSADGFKPCQACPVGTYQPEPGRTGCFPCGGGLLTKHEGTTSFQDCEAKVHCSPGHHYNTTTHRCIRCPVGTYQPEFGQNHCITCPGNTSTDFDGSTNVTHCKNQHCGGELGDYTGYIESPNYPGDYPANAECVWHIAPPPKRRILIVVPEIFLPIEDECGDVLVMRKSASPTSITTYETCQTYERPIAFTSRSRKLWIQFKSNEGNSGKGFQVPYVTYDEDYQQLIEDIVRDGRLYASENHQEILKDKKLIKALFDVLAHPQNYFKYTAQESKEMFPRSFIKLLRSKVSRFLRPYK

SEQ ID NO: 63541 - protein, 618 aa, Homo sapiens
METEAASTAVRTQTQAPRVVATRSTPSTQTVARASRRAQSITEAATGHARTQPLACDAAAPLDSHCSRTGRHAKTSTSAWSTTEAATTSAATPWAASSAAAGRATSCSPTSAPARTSTSAPSSGPVTTSASTPQARAKETARQPLLDHCHVTFVTLKCDSSKKRRRGRKSPSKEVSHITAEFEIETKMEEASDTCEADCLRKRAEQSLQAAIKTLRKSIGRQQFYVQVSGTEYEVAQRPAKALEGQGACGAGQVLQDSKCVACGPGTHFGGELGQCVSCMPGTYQDMEGQLSCTPCPSSDGLGLPGARNVSECGGQCSPGFFSADGFKPCQACPVGTYQPEPGRTGCFPCGGGLLTKHEGTTSFQDCEAKVHCSPGHHYNTTTHRCIRCPVGTYQPEFGQNHCITCPGNTSTDFDGSTNVTHCKNQHCGGELGDYTGYIESPNYPGDYPANAECVWHIAPPPKRRILIVVPEIFLPIEDECGDVLVMRKSASPTSITTYETCQTYERPIAFTSRSRKLWIQFKSNEGNSGKGFQVPYVTYDEDYQQLIEDIVRDGRLYASENHQEILKDKKLIKALFDVLAHPQNYFKYTAQESKEMFPRSFIKLLRSKVSRFLRPYK

SEQ ID NO: 63542 - protein, 363 aa, Homo sapiens [sequence omitted]

SEQ ID NO: 63543 - protein, 175 aa, Homo sapiens
  MOD_RES (1)..(1): Any amino acid
XRETPKGGVACDCRPGFDLAQNQKDCTLTCNYGNGGCQHSCEDTDTGPTCGCHQKYALHSDGRTCIEKDEAAIERSQFNATSVADVDKRVKRRLLMETCAVNNGGCDRTCKDTATGVRCSCPVGFTLQPDGKTCKDINECLVNNGGCDHFCRNTVGSFECGCRKGYKLLTDERTC

SEQ ID NO: 63544 - protein, 999 aa, Homo sapiens
MGVAGRNRPGAAWAVLLLLLLLPPLLLLAGAVPPGRGRAAGPQEDVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVEVKGLLPTSVSPRVSLHCGKSGGGDGCFLRCHSGIHLSSDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRTLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCHLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 63545 - protein, 807 aa, Homo sapiens
MGVAGRNRPGAAWAVLLLLLLLPPLLLLAGAVPPGRGRAAGPQEDVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVASCDLSCIVKRTEKRLRKAIRTLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCHLCALGTFQPEAGRTSCFPCGGGLATKHQGATSFQDCETRVQCSPGHFYNTTTHRCIRCPVGTYQPEFGKNNCVSCPGNTTTDFDGSTNITQCKTSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 63546 - protein, 1028 aa, Homo sapiens
MGVAGRNRPGAAWAVLLLLLLLPPLLLLAGAVPPGRGRAAGPQEDVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVEVKGLLPTSVSPRVSLHCGKSGGGDGCFLRCHSGIHLSSGLQGAYSVTCGSSSPLRNKQQKSNDSAFGDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRTLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCHLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 63547 - protein, 136 aa, Homo sapiens
MVLLESEQFLTELTRLFQKCRTSGSVYITLKKYDGRTKPIPKKGTVEGFEPADNKCLLRATDGKKKISTVVSSKEVNKFQMAYSNLLRANMDGLKKRDKKNKTKKTKAAAAAAAAAPAAAATAPTTAATTAATAAQ

SEQ ID NO: 63548 - protein, 110 aa, Homo sapiens
MACAAARSPADQDRFICIYPAYLNNKKTIAEGRRIPISKAVENPTATEIQDVCSAVGLNVFLEKNKMYSREWNRDVQYRGRVRVQLKQEDGSLCLVQFPSHYTLSLTSGS

SEQ ID NO: 63549 - protein, 144 aa, Homo sapiens
MACAAARSPADQDRFICIYPAYLNNKKTIAEGRRIPISKAVENPTATEIQDVCSAVGLNVFLEKNKMYSREWNRDVQYRGRVRVQLKQEDGSLCLVQFPSRKSVMLYAAEMIPKLKTRTQKTGGADQSLQQGEGSKKGKGKKKK

SEQ ID NO: 63550 - protein, 78 aa, Homo sapiens
MACAAARSPADQDRLLKILQLQRFKMYVQQLDLTYFLRKIKCTLENGIVMSNTEAESGSSSNRKMGASALYSSHHVSQ

SEQ ID NO: 63551 - protein, 504 aa, Homo sapiens
MVLADLGRKITSALRSLSNATIINEEVLNAMLKEVCTALLEADVNIKLVKQLRENVKSAIDLEEMASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMDPVIIASEGVEKFKNENFEIIIVDTSGRHKQEDSLFEEMLQVANAIQPDNIVYVMDASIGQACEAQAKAFKDKVDVASVIVTKLDGHAKGGGALSAVAATKSPIIFIGTGEHIDDFEPFKTQPFISKLLGMGDIEGLIDKVNELKLDDNEALIEKLKHGQFTLRDMYEQFQNIMKMGPFSQILGMIPGFGTDFMSKGNEQESMARLKKLMTIMDSMNDQELDSTDGAKVFSKQPGRIQRVARGSGVSTRDVQELLTQYTKFAQMVKKMGGIKGLFKGGDMSKNVSQSQMAKLNQQMAKMMDPRVLHHMGGMAGLQSMMRQFQQGAAGNMKGMMGFNNM

SEQ ID NO: 63552 - protein, 455 aa, Homo sapiens
MPPLSMKRSAIDLEEMASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMDPVIIASEGVEKFKNENFEIIIVDTSGRHKQEDSLFEEMLQVANAIQPDNIVYVMDASIGQACEAQAKAFKDKVDVASVIVTKLDGHAKGGGALSAVAATKSPIIFIGTGEHIDDFEPFKTQPFISKLLGMGDIEGLIDKVNELKLDDNEALIEKLKHGQFTLRDMYEQFQNIMKMGPFSQILGMIPGFGTDFMSKGNEQESMARLKKLMTIMDSMNDQELDSTDGAKVFSKQPGRIQRVARGSGVSTRDVQELLTQYTKFAQMVKKMGGIKGLFKGGDMSKNVSQSQMAKLNQQMAKMMDPRVLHHMGGMAGLQSMMRQFQQGAAGNMKGMMGFNNM

SEQ ID NO: 63553 - protein, 44 aa, Homo sapiens
MVLADLGRKITSALRSLSNATIINEEVLNAMLKEVCTALLEADV

SEQ ID NO: 63554 - protein, 74 aa, Homo sapiens
MVLADLGRKITSALRSLSNATIINEEVLNAMLKEVCTALLEADVNIKLVKQLRENVKSAIDLEEMASGLNKRKM

SEQ ID NO: 63555 - protein, 504 aa, Homo sapiens; identical to SEQ ID NO: 63551

SEQ ID NO: 63556 - protein, 596 aa, Homo sapiens
MAAEKQVPGGGGGGGSGGGGGSGGGGSGGGRGAGGEENKENERPSAGSKANKEFGDSLSLEILQIIKESQQQHGLRHGDFQRYRGYCSRRQRRLRKTLNFKMGNRHKFTGKKVTEELLTDNRYLLLVLMDAERAWSYAMQLKQEANTEPRKRFHLLSRLRKAVKHAEELERLCESNRVDAKTKLEAQAYTAYLSGMLRFEHQEWKAAIEAFNKCKTIYEKLASAFTEEQAVLYNQRVEEISPNIRYCAYNIGETRAKQAATMSEVEWRGRTVPVKIDKVRIFLLGLADNEAAIVQAESEETKERLFESMLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQPIPCKPLFFDLALNHVAFPPLEDKLEQKTKSGLTGYIKGIFGFRS

SEQ ID NO: 63557 - protein, 627 aa, Homo sapiens
MAAEKQVPGGGGGGGSGGGGGSGGGGSGGGRGAGGEENKENERPSAGSKANKEFGDSLSLEILQIIKESQQQHGLRHGDFQRYRGYCSRRQRRLRKTLNFKMGNRHKFTGKKVTEELLTDNRYLLLVLMDAERAWSYAMQLKQEANTEPRKRFHLLSRLRKAVKHAEELERLCESNRVDAKTKLEAQAYTAYLSGMLRFEHQEWKAAIEAFNKCKTIYEKLASAFTEEQAVLYNQRVEEISPNIRYCAYNIGDQSAINELMQMRLRSGGTEGLLAEKLEALITQTRAKQAATMSEVEWRGRTVPVKIDKVRIFLLGLADNEAAIVQAESEETKERLFESMLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQPIPCKPLFFDLALNHVAFPPLEDKLEQKTKSGLTGYIKGIFGFRS

SEQ ID NO: 63558 - protein, 526 aa, Homo sapiens [sequence omitted]

SEQ ID NO: 63559 - protein, 327 aa, Homo sapiens
MQMRLRSGGTEGLLAEKLEALITQTRAKQAATMSEVEWRGRTVPVKIDKVRIFLLGLADNEAAIVQAESEETKERLFESMLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFESTPGTDGALKRFVMLLQYHGFEMNSSLL

SEQ ID NO: 63560 - protein, 589 aa, Homo sapiens
MAAEKQVPGGGGGGGSGGGGGSGGGGSGGGRGAGGEENKENERPSAGSKANKEFGDSLSLEILQIIKESQQQHGLRHGDFQRYRYLLLVLMDAERAWSYAMQLKQEANTEPRKRFHLLSRLRKAVKHAEELERLCESNRVDAKTKLEAQAYTAYLSGMLRFEHQEWKAAIEAFNKCKTIYEKLASAFTEEQAVLYNQRVEEISPNIRYCAYNIGDQSAINELMQMRLRSGGTEGLLAEKLEALITQTRAKQAATMSEVEWRGRTVPVKIDKVRIFLLGLADNEAAIVQAESEETKERLFESMLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQPIPCKPLFFDLALNHVAFPPLEDKLEQKTKSGLTGYIKGIFGFRS

SEQ ID NO: 63561 - protein, 369 aa, Homo sapiens
MAAEKQVPGGGGGGGSGGGGGSGGGGSGGGRGAGGEENKENERPSAGSKANKEFGDSLSLEILQIIKESQQQHGLRHGDFQRYRGYCSRRQRRLRKTLNFKMGNRHKFTGKKVTEELLTDNRYLLLVLMDAERAWSYAMQLKQEANTEPRKRFHLLSRLRKAVKHAEELERLCESNRVDAKTKLEAQAYTAYLSGMLRFEHQEWKAAIEAFNKCKTIYEKLASAFTEEQAVLYNQRVEEISPNIRYCAYNIGDQSAINELMQMRLRSGGTEGLLAEKLEALITQTRAKQAATMSEVEWRGRTVPVKIDKVRIFLLGLADNEAAIVQAESEETKERLFESMLSECRDAIQVVREELKPDQRDLLLPSQGQ

SEQ ID NO: 63562 - protein, 288 aa, Homo sapiens
MLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQPIPCKPLFFDLALNHVAFPPLEDKLEQKTKSGLTGYIKGIFGFRS

SEQ ID NO: 63563 - protein, 671 aa, Homo sapiens
MASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 63564 - protein, 625 aa, Homo sapiens
PLVSSKMASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTQDLAVLQQYLPLQVTSYPQDTRNLQGLQQQKRNSNRKRRKVEKVAGDENILVAGCF

SEQ ID NO: 63565 - protein, 610 aa, Homo sapiens
MASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 63566 - protein, 638 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLREAEESSKIRAPTTMKKFEDSEKAKKPVRSMIETRGEKPKEKAKNSKKKGAKKEGSDGPLATSKPVPAEKSGLPVGPENGVELSKEELIRRKREEFIQKHGRGMEKSNKSTKSDAPKEKGKKAPRVWELGGCANKEVLDYSTPTTNGTPEAALSEDINLIRGTGSGGQLQDLDCSSSDDEGAAQNSTKPSATKGTLGGMFGMLKGLVGSKSLSREDMESVLDKMRDHLIAKNVAADIAVQLCESVANKLEGKVMGTFSTVTSTVKQALQESLVQILQPQRRVDMLRDIMDAQRRQRPYVVTFCGVNGVGKSTNLAKISFWLLENGFSVLIAACDTFRAGAVEQLRTHTRRLSALHPPEKHGGRTMVQLFEKGYGKDAAGIAMEAIAFARNQGFDVVLVDTAGRMQDNAPLMTALAKLITVNTPDLVLFVGEALVGNEAVDQLVKFNRALADHSMAQTPRLIDGIVLTKFDTIDDKVGAAISMTYITSKPIVFVGTGQTYCDLRSLNAKAVVAALMKA

SEQ ID NO: 63567 - protein, 183 aa, Homo sapiens
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 63568 - protein, 183 aa, Homo sapiens; identical to SEQ ID NO: 63567

SEQ ID NO: 63569 - protein, 85 aa, Homo sapiens
MRLLSFVVLALFAVTQAEEGARLLASKSLLNRYAVEGRDLTLQYNIYNVGSSAALDVELSDDSFPPEDFGIVSGMLNVKWDRIAP

SEQ ID NO: 63570 - protein, 147 aa, Homo sapiens
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHF

SEQ ID NO: 63571 - protein, 173 aa, Homo sapiens
MAAMASLGALALLLLSSLSRCSAEACLEPQITPSYYTTSDAVISTETVFIVEISLTCKNRVQNMALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 63572 - protein, 148 aa, Homo sapiens
MAAMASLGALALLLLSSLSRCSAEACLEPQITPSYYTTSDAVISTETVFIVEISLTCKNRVQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 63573 - protein, 173 aa, Homo sapiens; identical to SEQ ID NO: 63571

SEQ ID NO: 63574 - protein, 173 aa, Homo sapiens; identical to SEQ ID NO: 63571

SEQ ID NO: 63575 - protein, 120 aa, Homo sapiens
  MOD_RES (1)..(1): Any amino acid
XVGSGCRSAAVSALVVRVAPPCPLCPHSAQHPTQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 63576 - protein, 847 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 63577 - protein, 847 aa, Homo sapiens; identical to SEQ ID NO: 63576

SEQ ID NO: 63578 - protein, 737 aa, Homo sapiens
MEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 63579 - protein, 737 aa, Homo sapiens; identical to SEQ ID NO: 63578

SEQ ID NO: 63580 - protein, 737 aa, Homo sapiens; identical to SEQ ID NO: 63578

SEQ ID NO: 63581 - protein, 679 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMALIPP

SEQ ID NO: 63582 - protein, 730 aa, Homo sapiens
MEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGHSPSCSPPTMGNLGSQCPTWT

SEQ ID NO: 63583 - protein, 847 aa, Homo sapiens; identical to SEQ ID NO: 63576

SEQ ID NO: 63584 - protein, 64 aa, Homo sapiens
MSLWGLVSKMPPEKVQRLYVDFPQHLRHLLGDWLESQPWEFLVGSDAFCCNLASALLSDTVQHL

SEQ ID NO: 63585 - protein, 144 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEI

SEQ ID NO: 63586 - protein, 154 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKG

SEQ ID NO: 63587 - protein, 105 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQG

SEQ ID NO: 63588 - protein, 103 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQIL

SEQ ID NO: 63589 - protein, 159 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQ

SEQ ID NO: 63590 - protein, 847 aa, Homo sapiens; identical to SEQ ID NO: 63576

SEQ ID NO: 63591 - protein, 74 aa, Homo sapiens
MSLWGLVSKMPPEKVQRLYVDFPQHLRHLLGDWLESQPWEFLVGSDAFCCNLASALLSDTVQHLQASVGEQGEG

SEQ ID NO: 63592 - protein, 187 aa, Homo sapiens
MLGHPKVCEKLKALMVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQF

SEQ ID NO: 63593 - protein, 540 aa, Homo sapiens
MPLFATNPFDQDVEKATSEMNTAEDWGLILDICDKVGQSRTGPKDCLRSIMRRVNHKDPHVAMQALTLLGACVSNCGKIFHLEVCSRDFASEVSNVLNKGHPKVCEKLKALMVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQFSDDVQVETIEPEPEPAFIDEDKMDQLLQMLQSTDPSDDQPDLPELLHLEAMCHQMGPLIDEKLEDIDRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPNTMVSSVQGNTYPSQAPVYSPPPAATAAAATADVTLYQNAGPNMPQVPNYNLTSSTLPQPGGSQQPPQPQQPYSQKALL

SEQ ID NO: 63594 - protein, 118 aa, Homo sapiens
MRRVNHKDPHVAMQALTLLGACVSNCGKIFHLEVCSRDFASEVSNVLNKGHPKVCEKLKALMVEWTDEFKNDPQLSLISAMIKNLKEQGVTFPAIGSQAAEQAKASPALVAKDPGTVA

SEQ ID NO: 63595 - protein, 429 aa, Homo sapiens
MVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQFSDDVQVETIEPEPEPAFIDEDKMDQLLQMLQSTDPSDDQPDLPELLHLEAMCHQMGPLIDEKLEDIDRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPNTMVSSVQGNTYPSQAPVYSPPPAATAAAATADVTLYQNAGPNMPQVPNYNLTSSTLPQPGGSQQPPQPQQPYSQKALL

SEQ ID NO: 63596 - protein, 525 aa, Homo sapiens [sequence omitted]

SEQ ID NO: 63597 - protein, 1042 aa, Homo sapiens
MPMWAGGVGSPRRGMAPASTDDLFARKLRQPARPPLTPHTFEPRPVRGPLLRSGSDAGEARPPTPASPRARAHSHEEASRPAATSTRLFTDPLALLGLPAEEPEPAFPPVLEPRWFAHYDVQSLLFDWAPRSQGMGSHSEASSGTLASAEDQAASSDLLHGAPGFVCELGGEGELGLGGPASPPVPPALPNAAVSILEEPQNRTSAYSLEHADLGAGYYRKYFYGKEHQNFFGMDESLGPVAVSLRREEKEGSGGGTLHSYRVIVRTTQLRTLRGTISEDALPPGPPRGLSPRKLLEHVAPQLSPSCLRLGSASPKVPRTLLTLDEQVLSFQRKVGILYCRAGQGSEEEMYNNQEAGPAFMQFLTLLGDVVRLKGFESYRAQLDTKTDSTGTHSLYTTYQDHEIMFHVSTMLPYTPNNQQQLLRKRHIGNDIVTIVFQEPGSKPFCPTTIRSHFQHVFLVVRAHTPCTPHTTYRVAVSRTQDTPAFGPALPAGGGPFAANADFRAFLLAKALNGEQAAGHARQFHAMATRTRQQYLQDLATNEVTTTSLDSASRFGLPSLGGRRRAAPRGPGAELQAAGSLVWGVRAAPGARVAAGAQASGPEGIEVPCLLGISAEALVLVAPRDGRVVFNCACRDVLAWTFSEQQLDLYHGRGEAITLRFDGSPGQAVGEVVARLQLVSRGCETRELALPRDGQGRLGFEVDAEGFVTHVERFTFAETAGLRPGARLLRVCGQTLPSLRPEAAAQLLRSAPKVCVTVLPPDESGRPRRSFSELYTLSLQEPSRRGAPDPVQDEVQGVTLLPTTKQLLHLCLQDGGSPPGPGDLAEERTEFLHSQNSLSPRSSLSDEAPVLPNTTPDLLLATTAKPSVPSADSETPLTQDRPGSPSGSEDKGNPAPELRASFLPRTLSLRNSISRIMSEAGSGTLEDEWQAISEIASTCNTILESLSREGQPIPESGDPKGTPKSDAEPEPGNLSEKVSHLESMLRKLQEDLQKEKADRAALEEEVRSLRHNNRRLQAESESAATRLLLASKQLGSPTADLA

SEQ ID NO: 63598 - protein, 940 aa, Homo sapiens
MPMWAGGVGSPRRGMAPASTDDLFARKLRQPARPPLTPHTFEPRPVRGPLLRSGSDAGEARPPTPASPRARAHSHEEASRPAATSTRLFTDPLALLGLPAEEPEPAFPPVLEPRWFAHYDVQSLLFDWAPRSQGMGSHSEASSGTLASAEDQAASSDLLHGAPGFVCELGGEGELGLGGPASPPVPPALPNAAVSILEEPQNRTSAYSLEHADLGAGYYRKYFYGKEHQNFFGMDESLGPVAVSLRREEKEGSGGGTLHSYRVIVRTTQLRTLRGTISEDALPPGPPRGLSPRKLLEHVAPQLSPSCLRLGSASPKVPRTLLTLDEQVLSFQRKVGILYCRAGQGSEEEMYNNQEAGPAFMQFLTLLGDVVRLKGFESYRAQLDTKTDSTGTHSLYTTYQDHEIMFHVSTMLPYTPNNQQQLLRKRHIGNDIVTIVFQEPGSKPFCPTTIRSHFQHVFLVVRAHTPCTPHTTYRVAVSRTQDTPAFGPALPAGGGPFAANADFRAFLLAKALNGEQAAGHARQFHAMATRTRQQYLQDLATNEQLDLYHGRGEAITLRFDGSPGQAVGEVVARLQLVSRGCETRELALPRDGQGRLGFEVDAEGFVTHVERFTFAETAGLRPGARLLRVCGQTLPSLRPEAAAQLLRSAPKVCVTVLPPDESGRPRRSFSELYTLSLQEPSRRGAPDPVQDEVQGVTLLPTTKQLLHLCLQDGGSPPGPGDLAEERTEFLHSQNSLSPRSSLSDEAPVLPNTTPDLLLATTAKPSVPSADSETPLTQDRPGSPSGSEDKGNPAPELRASFLPRTLSLRNSISRIMSEAGSGTLEDEWQAISEIASTCNTILESLSREGQPIPESGDPKGTPKSDAEPEPGNLSEKVSHLESMLRKLQEDLQKEKADRAALEEEVRSLRHNNRRLQAESESAATRLLLASKQLGSPTADLA

SEQ ID NO: 63599 - protein, 6 aa, Homo sapiens
MPMWAG

SEQ ID NO: 63600 - protein, 103 aa, Homo sapiens
MPMWAGGVGSPRRGMAPASTDDLFARKLRQPARPPLTPHTFEPRPVRGPLLRSGSDAGEARPPTPASPRARAHSHEEASRPAATSTRLFTDPLALLGLPAEEP

SEQ ID NO: 63601 - protein, 1042 aa, Homo sapiens; identical to SEQ ID NO: 63597

SEQ ID NO: 63602 - protein, 1722 aa, Homo sapiens
MSDPRQSQEEKHKLGRASSKFKDPPRIMQSDDYFARKFKAINGNMGPTTSLNASNSNETGGGGPANGTPAVPKMGVRARVSEWPPKKDCSKELTCKALWESRSQTSYESITSVLQNGQSDQSEGQQDEQLDLDFVEAKYTIGDIFVHSPQRGLHPIRQRSNSDVTISDIDAEDVLDQNAVNPNTGAALHREYGSTSSIDRQGLSGENFFAMLRGYRVENYDHKAMVPFGFPEFFRCDPAISPSLHAAAQISRGEFVRISGLDYVDSALLMGRDRDKPFKRRLKSESVETSLFRKLRTVKSEHETFKFTSELEESRLERGIRPWNCQRCFAHYDVQSILFNINEAMATRANVGKRKNITTGASAASQTQMPTGQTGNCESPLGSKEDLNSKENLDADEGDGKSNDLVLSCPYFRNETGGEGDRRIALSRANSSSFSSGESCSFESSLSSHCTNAGVSVLEVPRENQPIHREKVKRYIIEHIDLGAYYYRKFFYGKEHQNYFGIDENLGPVAVSIRREKVEDAKEKEGSQFNYRVAFRTSELTTLRGAILEDAIPSTARHGTARGLPLKEVLEYVIPELSIQCLRQASNSPKVSEQLLKLDEQGLSFQHKIGILYCKAGQSTEEEMYNNETAGPAFEEFLDLLGQRVRLKGFSKYRAQLDNKTDSTGTHSLYTTYKDYELMFHVSTLLPYMPNNRQQLLRKRHIGNDIVTIVFQEPGALPFTPKSIRSHFQHVFVIVKVHNPCTENVCYSVGVSRSKDVPPFGPPIPKGVTFPKSAVFRDFLLAKVINAENAAHKSEKFRAMATRTRQEYLKDLAENFVTTATVDTSVKFSFITLGAKKKEKVKPRKDAHLFSIGAIMWHVIARDFGQSADIECLLGISNEFIMLIEKDSKNVVFNCSCRDVIGWTSGLVSIKVFYERGECVLLSSVDNCAEDIREIVQRLVIVTRGCETVEMTLRRNGLGQLGFHVNFEGIVADVEPFGFAWKAGLRQGSRLVEICKVAVATLTHEQMIDLLRTSVTVKVVIIQPHDDGSPRRGCSELCRIPMVEYKLDSEGTPCEYKTPFRRNTTWHRVPTPALQPLSRASPIPGTPDRLPCQQLLQQAQAAIPRSTSFDRKLPDGTRSSPSNQSSSSDPGPGGSGPWRPQVGYDGCQSPLLLEHQGSGPLECDGAREREDTMEASRHPETKWHGPPSKVLGSYKERALQKDGSCKDSPNKLSHIGDKSCSSHSSSNTLSSNTSSNSDDKHFGSGDLMDPELLGLTYIKGASTDSGIDTAPCMPATILGPVHLAGSRSLIHSRAEQWADAADVSGPDDEPAKLYSVHGYASTISAGSAAEGSMGDLSEISSHSSGSHHSGSPSAHCSKSSGSLDSSKVYIVSHSSGQQVPGSMSKPYHRQGAVNKYVIGWKKSEGSPPPEEPEVTECPGMYSEMDVMSTATQHQTVVGDAVAETQHVLSKEDFLKLMLPDSPLVEEGRRKFSFYGNLSPRRSLYRTLSDESICSNRRGSSFGSSRSSVLDQALPNDILFSTTPPYHSTLPPRAHPAPSMGSLRNEFWFSDGSLSDKSKCADPGLMPLPDTATGLDWTHLVDAARAFEGLDSDEELGLLCHHTSYLDQRVASFCTLTDMQHGQDLEGAQELPLCVDPGSGKEFMDTTGERSPSPLTGKVNQLELILRQLQTDLRKEKQDKAVLQAEVQHLRQDNMRLQEESQTATAQLRKFTEWFFTTIDKKS

SEQ ID NO: 63603 - protein, 778 aa, Homo sapiens
MSPCFSFIGCKLCSIVTRGCETVEMTLRRNGLGQLGFHVNFEGIVADVEPFGFAWKAGLRQGSRLVEICKVAVATLTHEQMIDLLRTSVTVKVVIIQPHDDGSPRRGCSELCRIPMVEYKLDSEGTPCEYKTPFRRNTTWHRVPTPALQPLSRASPIPGTPDRLPCQQLLQQAQAAIPRSTSFDRKLPDGTRSSPSNQSSSSDPGPGGSGPWRPQVGYDGCQSPLLLEHQGSGPLECDGAREREDTMEASRHPETKWHGPPSKVLGSYKERALQKDGSCKDSPNKLSHIGDKSCSSHSSSNTLSSNTSSNSDDKHFGSGDLMDPELLGLTYIKGASTDSGIDTAPCMPATILGPVHLAGSRSLIHSRAEQWADAADVSGPDDEPAKLYSVHGYASTISAGSAAEGSMGDLSEISSHSSGSHHSGSPSAHCSKSSGSLDSSKVYIVSHSSGQQVPGSMSKPYHRQGAVNKYVIGWKKSEGSPPPEEPEVTECPGMYSEMDVMSTATQHQTVVGDAVAETQHVLSKEDFLKLMLPDSPLVEEGRRKFSFYGNLSPRRSLYRTLSDESICSNRRGSSFGSSRSSVLDQALPNDILFSTTPPYHSTLPPRAHPAPSMGSLRNEFWFSDGSLSDKSKCADPGLMPLPDTATGLDWTHLVDAARAFEDQRVASFCTLTDMQHGQDLEGAQELPLCVDPGSGKEFMDTTGERSPSPLTGKVNQLELILRQLQTDLRKEKQDKAVLQAEVQHLRQDNMRLQEESQTATAQLRKFTEWFFTTIDKKS

SEQ ID NO: 63604 - protein, 1722 aa, Homo sapiens; identical to SEQ ID NO: 63602

SEQ ID NO: 63605 - protein, 305 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSGKTNHYQTTVEKKSLTIYAQVQKPGPLQKKLDSFPAQDPCTTIYVAATEPVPESVQETNSITVYASVTLPES

SEQ ID NO: 63606 - protein, 335 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 63607 - protein, 298 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGDSHHQTSDLF

SEQ ID NO: 63608 - protein, 144 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKSLHFGYLYFVLGADHDNLQT

SEQ ID NO: 63609 - protein, 269 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRASSEET

SEQ ID NO: 63610 - protein, 342 aa, Homo sapiens
MCSTMSAPTCLAHLPPCFLLLALVLVPSDASGQSSRNDWQVLQPEGPMLVAEGETLLLRCMVVGSCTDGMIKWVKVSTQDQQEIYNFKRGSFPGVMPMIQRTSEPLNCDYSIYIHNVTREHTGTYHCVRFDGLSEHSEMKSDEGTSVLVKGAGDPEPDLWIIQPQELVLGTTGDTVFLNCTVLGDGPPGPIRWFQGAGLSREAIYNFGGISHPKETAVQASNNDFSILLQNVSSEDAGTYYCVKFQRKPNRQYLSGQGTSLKVKAKSTSSKEAEFTSEPATEMSPTGLLVVFAPVVLGLKAITLAALLLALATSRRSPGQEDVKTTGPAGAMNTLAWSKGQE

SEQ ID NO: 63611 - protein, 207 aa, Homo sapiens
MCSTMSAPTCLAHLPPCFLLLALVLVPSDASGQSSRNDWQVLQPEGPMLVAEGAGDPEPDLWIIQPQELVLGTTGDTVFLNCTVLGDGPPGPIRWFQGAGLSREAIYNFGGISHPKETAVQASNNDFSILLQNVSSEDAGTYYCVKFQRKPNRQYLSGQGTSLKVKEQNLPLPKRQNSPVNLQLRCLQQVSVPTSVESMSPPQARGP

SEQ ID NO: 63612 - protein, 207 aa, Homo sapiens; identical to SEQ ID NO: 63611

SEQ ID NO: 63613 - protein, 244 aa, Homo sapiens
MCSTMSAPTCLAHLPPCFLLLALVLVPSDASGQSSRNDWQVLQPEGPMLVAEGAGDPEPDLWIIQPQELVLGTTGDTVFLNCTVLGDGPPGPIRWFQGAGLSREAIYNFGGISHPKETAVQASNNDFSILLQNVSSEDAGTYYCVKFQRKPNRQYLSGQGTSLKVKAKSTSSKEAEFTSEPATEMSPTGLLVVFAPVVLGLKAITLAALLLALATSRRSPGQEDVKTTGPAGAMNTLAWSKGQE

SEQ ID NO: 63614 - protein, 210 aa, Homo sapiens
MKSDEGTSVLVKGAGDPEPDLWIIQPQELVLGTTGDTVFLNCTVLGDGPPGPIRWFQGAGLSREAIYNFGGISHPKETAVQASNNDFSILLQNVSSEDAGTYYCVKFQRKPNRQYLSGQGTSLKVKAKSTSSKEAEFTSEPATEMSPTGERTHLSGVNESPTGKGAMNGLVMGREQSQTPGANLPPRMLPGLHLNCRTRTPENHVITAQL

SEQ ID NO: 63615 - protein, 276 aa, Homo sapiens
MPVPASWPHPPGPFLLLTLLLGLTEVAGEEELQMIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGAKPSAPVVLGPAARTTPEHTVSFTCESHGFSPRDITLKWFKNGNELSDFQTNVDPTGQSVAYSIRSTARVVLDPWDVRSQVICEVAHVTLQGDPLRGTANLSEAIRGPASSLTALLLIAVLLGPIYVPWKQKT

SEQ ID NO: 63616 - protein, 387 aa, Homo sapiens
MPVPASWPHPPGPFLLLTLLLGLTEVAGEEELQMIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGAKPSAPVVLGPAARTTPEHTVSFTCESHGFSPRDITLKWFKNGNELSDFQTNVDPTGQSVAYSIRSTARVVLDPWDVRSQVICEVAHVTLQGDPLRGTANLSEAIRVPPTLEVTQQPMRVGNQVNVTCQVRKFYPQSLQLTWSENGNVCQRETASTLTENKDGTYNWTSWFLVNISDQRDDVVLTCQVKHDGQLAVSKRLALEVTVHQKDQSSDATPGPASSLTALLLIAVLLGPIYVPWKQKT

SEQ ID NO: 63617 - protein, 170 aa, Homo sapiens
MPVPASWPHPPGPFLLLTLLLGLTEVAGEEELQMIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGGPASSLTALLLIAVLLGPIYVPWKQKT

SEQ ID NO: 63618 - protein, 354 aa, Homo sapiens
MIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGAKPSAPVVLGPAARTTPEHTVSFTCESHGFSPRDITLKWFKNGNELSDFQTNVDPTGQSVAYSIRSTARVVLDPWDVRSQVICEVAHVTLQGDPLRGTANLSEAIRVPPTLEVTQQPMRVGNQVNVTCQVRKFYPQSLQLTWSENGNVCQRETASTLTENKDGTYNWTSWFLVNISDQRDDVVLTCQVKHDGQLAVSKRLALEVTVHQKDQSSDATPGPASSLTALLLIAVLLGPIYVPWKQKT

SEQ ID NO: 63619 - protein, 276 aa, Homo sapiens; identical to SEQ ID NO: 63615

SEQ ID NO: 63620 - protein, 461 aa, Homo sapiens
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 63621 - protein, 461 aa, Homo sapiens; identical to SEQ ID NO: 63620

SEQ ID NO: 63622 - protein, 95 aa, Homo sapiens
MAPQSLPSSRMAPLGMLLGLLMAACFTFCLSHQNLKEFALTNPEKSSTKETERKETKAEEELDAEVLEVFHPTHEWQALQPGQAVPAGSHVRLNL

SEQ ID NO: 63623 - protein, 163 aa, Homo sapiens
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRP

SEQ ID NO: 63624 - protein, 123 aa, Homo sapiens
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINT

SEQ ID NO: 63625 - protein, 192 aa, Homo sapiens
MAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKMDNAQDLLSFGGLQVVINGLNSTEPLVKEYAAFVLGAAFSSNPKVQVEAIEGGALQKLLVIL

SEQ ID NO: 63626 - protein, 1273 aa, Homo sapiens
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKVEDALSYLDQVKLQFGSQPQVYNDFLDIMKEFKSQSIDTPGVISRVSQLFKGHPDLIMGFNTFLPPGYKIEVQTNDMVNVTTPGQVHQIPTHGIQPQPQPPPQHPSQPSAQSAPAPAQPAPQPPPAKVSKPSQLQAHTPASQQTPPLPPYASPRSPPVQPHTPVTISLGTAPSLQNNQPVEFNHAINYVNKIKNRFQGQPDIYKAFLEILHTYQKEQRNAKEAGGNYTPALTEQEVYAQVARLFKNQEDLLSEFGQFLPDANSSVLLSKTTAEKVDSVRNDHGGTVKKPQLNNKPQRPSQNGCQIRRHPTGTTPPVKKKPKLLNLKDSSMADASKHGGGTESLFFDKVRKALRSAEAYENFLRCLVIFNQEVISRAELVQLVSPFLGKFPELFNWFKNFLGYKESVHLETYPKERATEGIAMEIDYASCKRLGSSYRALPKSYQQPKCTGRTPLCKEVLNDTWVSFPSWSEDSTFVSSKKTQYEEHIYRCEDERFELDVVLETNLATIRVLEAIQKKLSRLSAEEQAKFRLDNTLGGTSEVIHRKALQRIYADKAADIIDGLRKNPSIAVPIVLKRLKMKEEEWREAQRGFNKVWREQNEKYYLKSLDHQGINFKQNDTKVLRSKSLLNEIESIYDERQEQATEENAGVPVGPHLSLAYEDKQILEDAAALIIHHVKRQTGIQKEDKYKIKQIMHHFIPDLLFAQRGDLSDVEEEEEEEMDVDEATGAVKKHNGVGGSPPKSKLLFSNTAAQKLRGMDEVYNLFYVNNNWYIFMRLHQILCLRLLRICSQAERQIEEENREREWEREVLGIKRDKSDSPAIQLRLKEPMDVDVEDYYPAFLDMVRSLLDGNIDSSQYEDSLREMFTIHAYIAFTMDKLIQSIVRQLQHIVSDEICVQVTDLYLAENNNGATGGQLNTQNSRSLLESTYQRKAEQLMSDENCFKLMFIQSQGQVQLTIELLDTEEENSDDPVEAERWSDYVERYMNSDTTSPELREHLAQKPVFLPRNLRRIRKCQRGREQQEKEGKEGNSKKTMENVDSLDKLECRFKLNSYKMVYVIKSEDYMYRRTALLRAHQSHERVSKRLHQRFQAWVDKWTKEHVPREMAAETSKWLMGEGLEGLVPCTTTCDTETLHFVSINKYRVKYGTVFKAP

SEQ ID NO: 63627 - protein, 1273 aa, Homo sapiens; identical to SEQ ID NO: 63626

SEQ ID NO: 63628 - protein, 1273 aa, Homo sapiens; identical to SEQ ID NO: 63626

SEQ ID NO: 63629 - protein, 1130 aa, Homo sapiens
MAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAVGKYGTLQEFSFFDKVRRVLKSQEVYENFLRCIALFNQELVSGSELLQLVSPFLGKFPELFAQFKSFLGVKELSFAPPMSDRSGDGISREIDYASCKRIGSSYRALPKTYQQPKCSGRTAICKEVLNDTWVSFPSWSEDSTFVSSKKTPYEEQLHRCEDERFELDVVLETNLATIRVLESVQKKLSRMAPEDQEKFRLDDSLGGTSEVIQRRAIYRIYGDKAPEIIESLKKNPVTAVPVVLKRLKAKEEEWREAQQGFNKIWREQYEKAYLKSLDHQAVNFKQNDTKALRSKSLLNEIESVYDEHQEQHSEGRSAPSSEPHLIFVYEDRQILEDAAALISYYVKRQPAIQKEDQGTIHQLLHQFVPSLFFSQQLDLGASEESADEDRDSPQGQTTDPSERKKPAPGPHSSPPEEKGAFGDAPATEQPPLPPPAPHKPLDDVYSLFFANNNWYFFLRLHQTLCSRLLKIYRQAQKQLLEYRTEKEREKLLCEGRREKGSDPAMELRLKQPSEVELEEYYPAFLDMVRSLLEGSIDPTQYEDTLREMFTIHAYVGFTMDKLVQNIARQLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 63630 - protein, 1162 aa, Homo sapiens
MAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAVGKYGTLQEFSFFDKVRRVLKSQEVYENFLRCIALFNQELVSGSELLQLVSPFLGKFPELFAQFKSFLGVKELSFAPPMSDRSGDGISREIDYASCKRIGSSYRALPKTYQQPKCSGRTAICKELDHWTLLQGSWTDDYCMSKFKNTCWIPGYSAGVLNDTWVSFPSWSEDSTFVSSKKTPYEEQLHRCEDERFELDVVLETNLATIRVLESVQKKLSRMAPEDQEKFRLDDSLGGTSEVIQRRAIYRIYGDKAPEIIESLKKNPVTAVPVVLKRLKAKEEEWREAQQGFNKIWREQYEKAYLKSLDHQAVNFKQNDTKALRSKSLLNEIESVYDEHQEQHSEGRSAPSSEPHLIFVYEDRQILEDAAALISYYVKRQPAIQKEDQGTIHQLLHQFVPSLFFSQQLDLGASEESADEDRDSPQGQTTDPSERKKPAPGPHSSPPEEKGAFGDAPATEQPPLPPPAPHKPLDDVYSLFFANNNWYFFLRLHQTLCSRLLKIYRQAQKQLLEYRTEKEREKLLCEGRREKGSDPAMELRLKQPSEVELEEYYPAFLDMVRSLLEGSIDPTQYEDTLREMFTIHAYVGFTMDKLVQNIARQLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 63631 - protein, 1056 aa, Homo sapiens
MSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKPPPKPTMPSRPIAPAPPSTLSLPPKVPGQVTVTMESSIPQASAIPVATISGQQGHPSNLHHIMTTNVQMSIIRSNAPGPPLHIGASHLPRGAAAAAVMSSSKVTTVLRPTSQLPNAATAQPAVQHIIHQPIQSRPPVTTSNAIPPAVVATVSATRAQSPVITTTAAHATDSALSRPTLSIQHPPSAAISIQRPAQSRDVTTRITLPSHPALGTPKQQLHTMAQKTIFSTGTPVAAATVAPILATNTIPSATTAGSVSHTQAPTSTIVTMTVPSHSSHATAVTTSNIPVAKVVPQQITHTSPRIQPDYPAERSSLIPISGHRASPNPVAMETRSDNRPSVPVQFQYFLPTYPPSAYPLAAHTYTPITSSVSTIRQYPVSAQAPNSAITAQTGVGVASTVHLNPMQLMTVDASHARHIQGIQPAPISTQGIQPAPIGTPGIQPAPLGTQGIHSATPINTQGLQPAPMGTQQPQPEGKTSVVLADGATIVANPISNPFSAAPAATTVVQTHSQSASTNAPAQGSSPRPSILRKKPATDGMAVRKTLIPPQPPDVASPRVESSMRSTSGSPRPAGAKPKSEIHVSMATPVTVSMETVSNQNNDQPTIAVPPTAQQPPPTIPTMIAAASPPSQPAVALSTIPGAVPITPPITTIAAAPPPSVTVGGSLSSVLGPPVPEIKVKEEVEPMDIMRPVSAVPPLATNTVSPSLALLANNLSMPTSDLPPGASPRKKPRKQQHVISTEEGDMMETNSTDDEKSTAKSLLVKAEKRKSPPKEYIDEEGVRYVPVRPRPPITLLRHYRNPWKAAYHHFQRYSDVRVKEEKKAMLQEIANQKGVSCRAQGWKVHLCAAQLLQLTNLEHDVYERLTNLQEGIIPKKKAATDDDLHRINELIQGNMQRCKLVMDQISEARDSMLKVLDHKDRVLKLLNKNGTVKKVSKLKRKEKV

SEQ ID NO: 63632 - protein, 1048 aa, Homo sapiens
MGPPRHPQAGEIEAGGAGGGRRLQVEMSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKPPPKPTMPSRPIAPAPPSTLSLPPKVPGQVTVTMESSIPQASAIPVATISGQQGHPSNLHHIMTTNVQMSIIRSNAPGPPLHIGASHLPRGAAAAAVMSSSKVTTVLRPTSQLPNAATAQPAVQHIIHQPIQSRPPVTTSNAIPPAVVATVSATRAQSPVITTTAAHATDSALSRPTLSIQHPPSAAISIQRPAQSRDVTTRITLPSHPALGTPKQQLHTMAQKTIFSTGTPVAAATVAPILATNTIPSATTAGSVSHTQAPTSTIVTMTVPSHSSHATAVTTSNIPVAKVVPQQITHTSPRIQPDYPAERSSLIPISGHRASPNPVAMETRSDNRPSVPVQFQYFLPTYPPSAYPLAAHTYTPITSSVSTIRQYPVSAQAPNSAITAQTGVGVASTVHLNPMQLMTVDASHARHIQGIQPAPISTQGIQPAPIGTPGIQPAPLGTQGIHSATPINTQGLQPAPMGTQQPQPEGKTSAVVLADGATIVANPISNPFSAAPAATTVVQTHSQSASTNAPAQGSSPRPSILRKKPATDGAKPKSEIHVSMATPVTVSMETVSNQNNDQPTIAVPPTAQQPPPTIPTMIAAASPPSQPAVALSTIPGAVPITPPITTIAAAPPPSVTVGGSLSSVLGPPVPEIKVKEEVEPMDIMRPVSAVPPLATNTVSPSLALLANNLSMPTSDLPPGASPRKKPRKQQHVISTEEGDMMETNSTDDEKSTAKSLLVKAEKRKSPPKEYIDEEGVRYVPVRPRPPITLLRHYRNPWKAAYHHFQRYSDVRVKEEKKAMLQEIANQKGVSCRAQGWKVHLCAAQLLQLTNLEHDVYERLTNLQEGIIPKKKAATDDDLHRINELIQGNMQRCKLVMDQISEARDSMLKVLDHKDRVLKLLNKNGTVKKVSKLKRKEKV

SEQ ID NO: 63633 - protein, 1083 aa, Homo sapiens
MGPPRHPQAGEIEAGGAGGGRRLQVEMSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKPPPKPTMPSRPIAPAPPSTLSLPPKVPGQVTVTMESSIPQASAIPVATISGQQGHPSNLHHIMTTNVQMSIIRSNAPGPPLHIGASHLPRGAAAAAVMSSSKVTTVLRPTSQLPNAATAQPAVQHIIHQPIQSRPPVTTSNAIPPAVVATVSATRAQSPVITTTAAHATDSALSRPTLSIQHPPSAAISIQRPAQSRDVTTRITLPSHPALGTPKQQLHTMAQKTIFSTGTPVAAATVAPILATNTIPSATTAGSVSHTQAPTSTIVTMTVPSHSSHATAVTTSNIPVAKVVPQQITHTSPRIQPDYPAERSSLIPISGHRASPNPVAMETRSDNRPSVPVQFQYFLPTYPPSAYPLAAHTYTPITSSVSTIRQYPVSAQAPNSAITAQTGVGVASTVHLNPMQLMTVDASHARHIQGIQPAPISTQGIQPAPIGTPGIQPAPLGTQGIHSATPINTQGLQPAPMGTQQPQPEGKTSAVVLADGATIVANPISNPFSAAPAATTVVQTHSQSASTNAPAQGSSPRPSILRKKPATDGMAVRKTLIPPQPPDVASPRVESSMRSTSGSPRPAGAKPKSEIHVSMATPVTVSMETVSNQNNDQPTIAVPPTAQQPPPTIPTMIAAASPPSQPAVALSTIPGAVPITPPITTIAAAPPPSVTVGGSLSSVLGPPVPEIKVKEEVEPMDIMRPVSAVPPLATNTVSPSLALLANNLSMPTSDLPPGASPRKKPRKQQHVISTEEGDMMETNSTDDEKSTAKSLLVKAEKRKSPPKEYIDEEGVRYVPVRPRPPITLLRHYRNPWKAAYHHFQRYSDVRVKEEKKAMLQEIANQKGVSCRAQGWKVHLCAAQLLQLTNLEHDVYERLTNLQEGIIPKKKAATDDDLHRINELIQGNMQRCKLVMDQISEARDSMLKVLDHKDRVLKLLNKNGTVKKVSKLKRKEKV

SEQ ID NO: 63634 - protein, 262 aa, Homo sapiens
MSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKPPPKPTMPSRPIAPAPPSTLSLPPKVPGQVTVTMESSIPQASAIPVATISGQQGHPSNLHHIMTTNVQMSIIRSNAPGPPLHIGASHLPRGAAAAAVMSSSKVTTVLRPTSQLPNAATAQPAVQHIIHQPIQSRPPVTTSNAIPPA

SEQ ID NO: 63635 - protein, 268 aa, Homo sapiens
MQQIRPPFIRGPPHHASNPNSPLSNPMLPGIGPPPGGPRNLGPTSSPMHRPMLSPHIHPPSTPTMPGNPPGLLPPPPPGAPLPSLPFPPVSMMPNGPMPVPQMMNFGLPSLAPLVPPPTLLVPYPVIVPLPVPIPIPIPIPHVSDSKPPKKLLSPEEPAVSELESVKENNCASNCHLDGEAAKKLMGEEALAGGDKSDPNLNNPADEDHAYALRMLPKTGCVIQPVPKPAEKAAMAPCIISSPMLSAGPEDLEPPLKRRCLRIRNQNK

SEQ ID NO: 63636 - protein, 873 aa, Homo sapiens
MAEMEKEGRPPENKRSRKPAHPVKREINEEMKNFAENTMNELLGWYGYDKVELKDGEDIEFRSYPTDGESRQHISVLKENSLPKPKLPEDSVISPYNISTGYSGLATGNGLSDSPAGSKDHGSVPIIVPLIPPPFIKPPAEDDVSNVQIMCAWCQKVGIKRYSLSMGSEVKSFCSEKCFAACRRAYFKRNKARDEDGHAENFPQQHYAKETPRLAFKNNCELLVCDWCKHIRHTKEYLDFGDGERRLQFCSAKCLNQYKMDIFYKETQANLPAGLCSTLHPPMENKAEGTGVQLLTPDSWNIPLTDARRKAPSPVATAGQSQGPGPSASTTVSPSDTANCSVTKIPTPVPKSIPISETPNIPPVSVQPPASIGPPLGVPPRSPPMVMTNRGPVPLPIFMEQQIMQQIRPPFIRGPPHHASNPNSPLSNPMLPGIGPPPGGPRNLGPTSSPMHRPMLSPHIHPPSTPTMPGNPPGLLPPPPPGAPLPSLPFPPVSMMPNGPMPVPQMMNFGLPSLAPLVPPPTLLVPYPVIVPLPVPIPIPIPIPHVSDSKPPNGFSSNGENFIPNAPGDSAAAGGKPSGHSLSPRDSKQGSSKSADSPPGCSGQALSLAPTPAEHGRSEVVDLTRRAGSPPGPPGAGGQLGFPGVLQGPQDGVIDLTVGHRARLHNVIHRALHAHVKAEREPSAAERRTCGGCRDGHCSPPAAGDPGPGAPAGPEAAAACNVIVNGTRGAAAEGAKSAEPPPEQPPPPPPPAPPKKLLSPEEPAVSELESVKENNCASNCHLDGEAAKKLMGEEALAGGDKSDPNLNNPADEDHAYALRMLPKTGCVIQPVPKPAEKAAMAPCIISSPMLSAGPEDLEPPLKRRCLRIRNQNK

SEQ ID NO: 63637 - protein, 410 aa, Homo sapiens
MPGVCDRAPDFLSPSEDQVLRPALGSSVALNCTAWVVSGPHCSLPSVQWLKDGLPLGIGGHYSLHEYSWVKANLSEVLVSSVLGVNVTSTEVYGAFTCSIQNISFSSFTLQRAGPTSHVAAVLASLLVLLALLLAALLYVKCRLNVLLWYQDAYGEVEINDGKLYDAYVSYSDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSVTPSSDFWKEVQLALPRKVQYRPVEGDPQTQLQDDKDPMLILRGRVPEGRALDSEVDPDPEGDLGVRGPVFGEPSAPPHTSGVSLGESRSSEVDVSDLGSRNYSARTDFYCLVSKDDM

SEQ ID NO: 63638 - protein, 504 aa, Homo sapiens
MPGVCDRAPDFLSPSEDQVLRPALGSSVALNCTAWVVSGPHCSLPSVQWLKDGLPLGIGGHYSLHEYSWVKANLSEVLVSSVLGVNVTSTEVYGAFTCSIQNISFSSFTLQRAGPTSHVAAVLASLLVLLALLLAALLYVKCRLNVLLWYQDAYGEVEINDGKLYDAYVSYSDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSVTPSSDFWKEVQLALPRKVQYRPVEGDPQTQLQDDKDPMLILRGRVPEGRALDSEVDPDPEGDLGMPAQPHSPTGEAQHRAEWGQAQGTGPGGAPGVEDSSRHREPLHGLCPGGARPSVCLGTSWASQAITAGGEQGQPLAVGLGQGCGWPPQASRSPHPRCPGACLWRAISSTAHQWGLAGREPEQRSGRLGSRLAKLQCPHRLLLPGVQG

SEQ ID NO: 63639 - protein, 410 aa, Homo sapiens; identical to SEQ ID NO: 63637

SEQ ID NO: 63640 - protein, 410 aa, Homo sapiens; identical to SEQ ID NO: 63637

SEQ ID NO: 63641 - protein, 504 aa, Homo sapiens; identical to SEQ ID NO: 63638

SEQ ID NO: 63642 - protein, 368 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQGPPGSQPSPHAQPPPHNPSSMMGPHSQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 63643 - protein, 361 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 63644 - protein, 388 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQGPPGSQPSPHAQPPPHNPSSMMGPHSQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 63645 - protein, 278 aa, Homo sapiens
MPGGPIPPGFFQGPPGSQPSPHAQPPPHNPSSMMGPHSQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 63646 - protein, 156 aa, Homo sapiens
PPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNVSLLSNNLHIRHHNKS

SEQ ID NO: 63647 - protein, 385 aa, Homo sapiens
MYAKGGKGSAVPSDSQAREKLALYVYEYLLHIGAQKSAQTFLSEIRWEKNITLGEPPGFLHSWWCVFWDLYCAAPDRREACEHSGEAKAFQDYSAAAAPSPVMGSMAPGDTMAAGSMAAGFFQGPPGSQPSPHNPNAPMMGPHGQPFMSPRFPGGPRPTLRMPSQPPAGLPGSQPLLPGAMEPSPRAQGHPSMGGPMQRVTPPRGMASVGPQSYGGGMRPPPNSLAGPGLPAMNMGPGVRGPWASPSGNSIPYSSSSPGSYTGPPGGGGPPGTPIMPSPGDSTNSSENMYTIMNPIGQGAGRANFPLGPGPEGPMAAMSAMEPHHVNGSLGSGDMDGLPKSSPGAVAGLSNAPGTPRDDGEMAAAGTFLHPFPSESYSPGMTMSV

SEQ ID NO: 63648 - protein, 363 aa, Homo sapiens
MYAKGGKGSAVPSDSQAREKLALYVYEYLLHIGAQKSAQTFLSEIRWEKNITLGEPPGFLHSWWCVFWDLYCAAPDRREACEHSGEAKAFQDYSAAAAPSPVMGSMAPGDTMAAGSMAAGFFQPFMSPRFPGGPRPTLRMPSQPPAGLPGSQPLLPGAMEPSPRAQGHPSMGGPMQRVTPPRGMASVGPQSYGGGMRPPPNSLAGPGLPAMNMGPGVRGPWASPSGNSIPYSSSSPGSYTGPPGGGGPPGTPIMPSPGDSTNSSENMYTIMNPIGQGAGRANFPLGPGPEGPMAAMSAMEPHHVNGSLGSGDMDGLPKSSPGAVAGLSNAPGTPRDDGEMAAAGTFLHPFPSESYSPGMTMSV

SEQ ID NO: 63649 - protein, 766 aa, Homo sapiens
MKEKSKNAARTRREKENSEFYELAKLLPLPSAITSQLDKASIIRLTTSYLKMRVVFPEGLGEAWGHSSRTSPLDNVGRELGSHLLQTLDGFIFVVAPDGKIMYISETASVHLGLSQVELTGNSIYEYIHPADHDEMTAVLTAHQPYHSHFVQEYEIERSFFLRMKCVLAKRNAGLTCGGYKVIHCSGYLKIRQYSLDMSPFDGCYQNVGLVAVGHSLPPSAVTEIKLHSNMFMFRASLDMKLIFLDSRVAELTGYEPQDLIEKTLYHHVHGCDTFHLRCAHHLLLVKGQVTTKYYRFLAKHGGWVWVQSYATIVHNSRSSRPHCIVSVNYVLTDTEYKGLQLSLDQISASKPAFSYTSSSTPTMTDNRKGAKSRLSSSKSKSRTSPYPQYSGFHTERSESDHDSQWGGSPLTDTASPQLLDPADRPGSQHDASCAYRQFSDRSSLCYGFALDHSRLVEERHFHTQACEGGRCEAGRYFLGTPQAGREPWWGSRAALPLTKASPESREAYENSMPHIASVHRIHGRGHWDEDSVVSSPDPGSASESGDRYRTEQYQSSPHEPSKIETLIRATQQMIKEEENRLQLRKAPSDQLASINGAGKKHSLCFANYQQPPPTGEVCHGSALANTSPCDHIQQREGKMLSPHENDYDNSPTALSRISSPNSDRISKSSLILAKDYLHSDISPHQTAGDHPTVSPNCFGSHRQYFDKHAYTLTGYALEHLYDSETIRNYSLGCNGSHFDVTSHLRMQPDPAQGHKGTSVIITNGS

SEQ ID NO: 63650 - protein, 766 aa, Homo sapiens; identical to SEQ ID NO: 63649

SEQ ID NO: 63651 - protein, 667 aa, Homo sapiens
MKEKSKNAAKTRREKENGEFYELAKLLPLPSAITSQLDKASIIRLTTSYLKMRAVFPEGLGDAWGQPSRAGPLDGVAKELGSHLLQTLDGFVFVVASDGKIMYISETASVHLGLSQVELTGNSIYEYIHPSDHDEMTAVLTAHQPLHHHLLQEYEIERSFFLRMKCVLAKRNAGLTCSGYKVIHCSGYLKIRQYMLDMSLYDSCYQIVGLVAVGQSLPPSAITEIKLYSNMFMFRASLDLKLIFLDSRVTEVTGYEPQDLIEKTLYHHVHGCDVFHLRYAHHLLLVKGQVTTKYYRLLSKRGGWVWVQSYATVVHNSRSSRPHCIVSVNYVLTEIEYKELQLSLEQVSTAKSQDSWRTALSTSQETRKLVKPKNTKMKTKLRTNPYPPQQYSSFQMDKLECGQLGNWRASPPASAAAPPELQPHSESSDLLYTPSYSLPFSYHYGHFPLDSHVFSSKKPMLPAKFGQPQGSPCEVARFFLSTLPASGECQWHYANPLVPSSSSPAKNPPEPPANTARHSLVPSYEAPAAAVRRFGEDTAPPSFPSCGHYREEPALGPAKAARQAARDGARLALARAAPECCAPPTPEAPGAPAQLPFVLLNYHRVLARRGPLGGAAPAASGLACAPGGPEAATGALRLRHPSPAATSPPGAPLPHYLGASVIITNGR

SEQ ID NO: 63652 - protein, 570 aa, Homo sapiens
MKEKSKNAAKTRREKENGEFYELAKLLPLPSAITSQLDKASIIRLTTSYLKMRAVFPEGLGDAWGQPSRAGPLDGVAKELGSHLLQTLDGFVFVVASDGKIMYISETASVHLGLSQVELTGNSIYEYIHPSDHDEMTAVLTAHQPLHHHLLQEYEIERSFFLRMKCVLAKRNAGLTCSGYKVIHCSGYLKIRQYMLDMSLYDSCYQIVGLVAVGQSLPPSAITEIKLYSNMFMFRASLDLKLIFLDSRVTEVTGYEPQDLIEKTLYHHVHGCDVFHLRYAHHLLLVKGQVTTKYYRLLSKRGGWVWVQSYATVVHNSRSSRPHCIVSVNYVLTEIEYKELQLSLEQVSTAKSQDSWRTALSTSQETRKLVKPKNTKMKTKLRTNPYPPQQYSSFQMDKLECGQLGNWRASPPASAAAPPELQPHSESSDLLYTPSYSLPFSYHYGHFPLDSHVFSSKKPMLPAKFGQPQGSPCEVARFFLSTLPASGECQWHYANPLVPSSSSPAKNPPEPPANTARHSLVPSYEGGSGLLVGKVGGLRTAGSRSSHGGGWQMETEPSRFGQTCPLSASK

SEQ ID NO: 63653 - protein, 148 aa, Homo sapiens
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIADNIIFLSDQTKEKE

SEQ ID NO: 63654 - protein, 121 aa, Homo sapiens
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMD

SEQ ID NO: 63655 - protein, 148 aa, Homo sapiens; identical to SEQ ID NO: 63653

SEQ ID NO: 63656 - protein, 135 aa, Homo sapiens
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIAD

SEQ ID NO: 63657 - protein, 28 aa, Homo sapiens
MFRRPVLQVLRQFVRHESETTTSLVLER

SEQ ID NO: 63658 - protein, 148 aa, Homo sapiens; identical to SEQ ID NO: 63653

SEQ ID NO: 63659 - protein, 148 aa, Homo sapiens; identical to SEQ ID NO: 63653

SEQ ID NO: 63660 - protein, 148 aa, Homo sapiens; identical to SEQ ID NO: 63653

SEQ ID NO: 63661 - protein, 361 aa, Homo sapiens
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYSAAAAPSPVLGNIPPGDGMPVGPVPPGFFQPFMSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 63662 - protein, 314 aa, Homo sapiens [sequence omitted]

SEQ ID NO: 63663 - protein, 341 aa, Homo sapiens
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYSAAAAPSPVLGNIPPGDGMPVGPVPPGFFQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 63664 - protein, 399 aa, Homo sapiens
MAFWGWRAAAALRLWGRVVERVEAGGGVGPFQACGCRLVLGGRDDVSAGLRGSHGARGEPLDPARPLQRPPRPEVPRAFRRQPRAAAPSFFFSSIKGGRRSISFSVGASSVVGSGGSSDKGKLSLQDVAELIRARACQRVVVMVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKLDGPDK

SEQ ID NO: 63665 - protein, 318 aa, Homo sapiens
MAFWGWRAAAALRLWGRVVERVEAGGGVGPFQACGCRLVLGGRDDDVAELIRARACQRVVVMVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKLDGPDK

SEQ ID NO: 63666 - protein, 257 aa, Homo sapiens
MVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKLDGPDK

SEQ ID NO: 63667 - protein, 314 aa, Homo sapiens
MKMSFALTFRSAKGRWIANPSQPCSKASIGLFVPASPPLDPEKVKELQRFITLSKRLLVMTGAGISTESGIPDYRSEKVGLYARTDRRPIQHGDFVRSAPIRQRYWARNFVGWPQFSSHQPNPAHWALSTWEKLGKLYWLVTQNVDALHTKAGSRRLTELHGCMDRVLCLDCGEQTPRGVLQERFQVLNPTWSAEAHGLAPDGDVFLSEEQVRSFQVPTCVQCGGHLKPDVVFFGDTVNPDKVDFVHKRVKEADSLLVVGSSLQVYSGYRFILTAWEKKLPIAILNIGPTRSDDLACLKLNSRCGELLPLIDPC

SEQ ID NO: 63668 - protein, 292 aa, Homo sapiens
MRPLQIVPSRLISQLYCGLKPPASTRNQICLKMARPSSSMADFRKFFAKAKHIVIISGAGVSAESGVPTFRGAGGYWRKWQAQDLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGCEEAGCGGLLRPHVVWFGENLDPAILEEVDRELAHCDLCLVVGTSSVVYPAAMFAPQVAARGVPVAEFNTETTPATNRFRFHFQGPCGTTLPEALACHENETVS

SEQ ID NO: 63669 - protein, 310 aa, Homo sapiens
MRPLQIVPSRLISQLYCGLKPPASTRNQICLKMARPSSSMADFRKFFAKAKHIVIISGAGVSAESGVPTFRGAGGYWRKWQAQDLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGAPEPGTQDASIPVEKLPRCEEAGCGGLLRPHVVWFGENLDPAILEEVDRELAHCDLCLVVGTSSVVYPAAMFAPQVAARGVPVAEFNTETTPATNRFRFHFQGPCGTTLPEALACHENETVS

SEQ ID NO: 63670 - protein, 299 aa, Homo sapiens
MRPLQIVPSRLISQLYCGLKPPASTRNQICLKMARPSSSMADFRKFFAKAKHIVIISGAGVSAESGVPTFRGAGGYWRKWQAQDLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGAPEPGTQDASIPVEKLPRCEEAGCGGLLRPHVVWFGENLDPAILEEVDRELAHCDLCLVVGTSSVVYPAAMFAPQVAARGVPVAEFNTETTPATNRFSHLISISSLIIIKN

SEQ ID NO: 63671 - protein, 202 aa, Homo sapiens
MGSKEPNAGHRAIAECETRLGKQGRRVVVITQNIDELHRKAGTKNLLEIHGSLFKTRCTSCGVVAENYKSPICPALSGKGAPEPGTQDASIPVEKLPRCEEAGCGGLLRPHVVWFGENLDPAILEEVDRELAHCDLCLVVGTSSVVYPAAMFAPQVAARGVPVAEFNTETTPATNRFRFHFQGPCGTTLPEALACHENETVS

SEQ ID NO: 63672 - protein, 400 aa, Homo sapiens
MAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKVT

SEQ ID NO: 63673 - protein, 320 aa, Homo sapiens
MPGPRRRSPSACPQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSRVL

SEQ ID NO: 63674 - protein, 284 aa, Homo sapiens
MSMLPSFGFTQEQVACVCEVLQQGGNLERLGRFLWSLPACDHLHKNESVLKAKAVVAFHRGNFRELYKILESHQFSPHNHPKLQQLWLKAHYVEAEKLRGRPLGAVGKYRVRRKFPLPRTIWDGEETSYCFKEKSRGVLREWYAHNPYPSPREKRELAEATGLTTTQVSNWFKNRRQRDRAAEAKERENTENNNSSSNKQNQLSPLEGGKPLMSSSEEEFSPPQSPDQNSVLLLQGNMGHARSSNYSLPGLTASQPSHGLQTHQHQLQDSLLGPLTSSLVDLGS

SEQ ID NO: 63675 - protein, 291 aa, Homo sapiens
MSMLPTFGFTQEQVACVCEVLQQGGNIERLGRFLWSLPACEHLHKNESVLKAKAVVAFHRGNFRELYKILESHQFSPHNHAKLQQLWLKAHYIEAEKLRGRPLGAVGKYRVRRKFPLPRSIWDGEETSYCFKEKSRSVLREWYAHNPYPSPREKRELAEATGLTTTQVSNWFKNRRQRDRAAEAKERENNENSNSNSHNPLNGSGKSVLGSSEDEKTPSGTPDHSSSSPALLLSPPPPGLPSLHSLGHPPGPSAVPVPVPGGGGADPLQHHHGLQDSILNPMSANLVDLGS

SEQ ID NO: 63676 - protein, 332 aa, Homo sapiens
MVFRSPLDLYSSHFLLPNFADSHHRSILLASSGGGNGAGGGGGAGGGSGGGNGAGGGGAGGAGGGGGGGSRAPPEELSMFQLPTLNFSPEQVASVCETLEETGDIERLGRFLWSLPVAPGACEAINKHESILRARAVVAFHTGNFRDLYHILENHKFTKESHGKLQAMWLEAHYQEAEKLRGRPLGPVDKYRVRKKFPLPRTIWDGEQKTHCFKERTRSLLREWYLQDPYPNPSKKRELAQATGLTPTQVGNWFKNRRQRDRAAAAKNRLQHQAIGPSGMRSLAEPGCPTHGSAESPSTAASPTTSVSSLTERADTGTSILSVTSSDSECDV

SEQ ID NO: 63677 - protein, 781 aa, Homo sapiens
MSSSSPTGQIASAADIKQENGMESASEGQEAHREVAGGAAVGLSPPAPAPFPLEPGDAATAAARVSGEEGAVAAAAAGAAADQVQLHSELLGRHHHAAAAAAQTPLAFSPDHVACVCEALQQGGNLDRLARFLWSLPQSDLLRGNESLLKARALVAFHQGIYPELYSILESHSFESANHPLLQQLWYKARYTEAERARGRPLGAVDKYRLRRKFPLPRTIWDGEETVYCFKEKSRNALKELYKQNRYPSPAEKRHLAKITGLSLTQVSNWFKNRRQRDRNPSETQSKSESDGNPSTEDESSKGHEDLSPHPLSSSSDGITNLSLSSHMEPVYMQQIGNAKISLSSSGVLLNGSLVPASTSPVFLNGNSFIQGPSGVILNGLNVGNTQAVALNPPKMSSNIVSNGISMTDILGSTSQDVKEFKVLQSSANSATTTSYSPSVPVSFPGLIPSTEVKREGIQTVASQDGGSVVTFTTPVQINQYGIVQIPNSGANSQFLNGSIGFSPLQLPPVSVAASQGNISVSSSTSDGSTFTSESTTVQQGKVFLSSLAPSAVVYTVPNTGQTIGSVKQEGLERSLVFSQLMPVNQNAQVNANLSSENISGSGLHPLASSLVNVSPTHNFSLSPSTLLNPTELNRDIADSQPMSAPVASKSTVTSVSNTNYATLQNCSLITGQDLLSVPMTQAALGEIVPTAEDQVGHPSPAVHQDFVQEHRLVLQSVANMKENFLSNSESKATSSLMMLDSKSKYVLDGMVDTVCEDLETDKKELAKLQTVQLDEDMQDL

SEQ ID NO: 63678 - protein, 739 aa, Homo sapiens
MATLPAEPSAGPAAGGEAVAAAAATEEEEEEARQLLQTLQAAEGEAAAAAGAGAGAAAAGAEGPGSPGVPGSPPEAASEPPTGLRFSPEQVACVCEALLQAGHAGRLSRFLGALPPAERLRGSDPVLRARALVAFQRGEYAELYRLLESRPFPAAHHAFLQDLYLRARYHEAERARGRALGAVDKYRLRKKFPLPKTIWDGEETVYCFKERSRAALKACYRGNRYPTPDEKRRLATLTGLSLTQVSNWFKNRRQRDRTGAGGGAPCKSESDGNPTTEDESSRSPEDLERGAAPVSAEAAAQGSIFLAGTGPPAPCPASSSILVNGSFLAASGSPAVLLNGGPVIINGLALGEASSLGPLLLTGGGGAPPPQPSPQGASETKTSLVLDPQTGEVRLEEAQSEAPETKGAQVAAPGPALGEEVLGPLAQVVPGPPTAATFPLPPGPVPAVAAPQVVPLSPPPGYPTGLSPTSPLLNLPQVVPTSQVVTLPQAVGPLQLLAAGPGSPVKVAAAAGPANVHLINSGVGVTALQLPSATAPGNFLLANPVSGSPIVTGVALQQGKIILTATFPTSMLVSQVLPPAPGLALPLKPETAISVPEGGLPVAPSPALPEAHALGTLSAQQPPPAAATTSSTSLPFSPDSPGLLPNFPAPPPEGLMLSPAAVPVWSAGLELSAGTEGLLEAEKGLGTQAPHTVLRLPDPDPEGLLLGATAGGEVDEGLEAEAKVLTQLQSVPVEEPLEL

SEQ ID NO: 63679 - protein, 246 aa, Homo sapiens
MFQLPILNFSPQQVAGVCETLEESGDVERLGRFLWSLPVAPAACEALNKNESVLRARAIVAFHGGNYRELYHILENHKFTKESHAKLQALWLEAHYQEAEKLRGRPLGPVDKYRVRKKFPLPRTIWDGEQKTHCFKERTRHLLREWYLQDPYPNPSKKRELAQATGLTPTQVGNWFKNRRQRDRAAAAKNRLQQQVLSQGSGRALRAEGDGTPEVLGVATSPAASLSSKAATSAISITSSDSECDI

SEQ ID NO: 63680 - protein, 119 aa, Homo sapiens
MTQQGAALQNYNNELVKCIEELCQKREELCRQIQEEEDEKQRLQNEVRQLTEKLARVNENLARKIASRNEFDRTIAETEAAYLKILESSQTLLSVLKREAGNLTKATAPDQKSSGGRDS

SEQ ID NO: 63681 - protein, 221 aa, Homo sapiens
MLWLFQSLLFVFCFGPGQLRNIQVTNHSQLFQNMTCELHLTCSVEDADDNVSFRWEALGNTLSSQPNLTVSWDPRISSEQDYTCIAENAVSNLSFSVSAQKLCEDVKIQYTDTKMILFMVSGICIVFGFIILLLLVLRKRRDSLSLSTQRTQGPAESARNLEYVSVSPTNNTVYASVTHSNRETEIWTPRENDTITIYSTINHSKESKPTFSRATALDNVV

SEQ ID NO: 63682 - protein, 332 aa, Homo sapiens
MLWLFQSLLFVFCFGPGNVVSQSSLTPLMVNGILGESVTLPLEFPAGEKVNFITWLFNETSLAFIVPHETKSPEIHVTNPKQGKRLNFTQSYSLQLSNLKMEDTGSYRAQISTKTSAKLSSYTLRILRQLRNIQVTNHSQLFQNMTCELHLTCSVEDADDNVSFRWEALGNTLSSQPNLTVSWDPRISSEQDYTCIAENAVSNLSFSVSAQKLCEDVKIQYTDTKMILFMVSGICIVFGFIILLLLVLRKRRDSLSLSTQRTQGPAESARNLEYVSVSPTNNTVYASVTHSNRETEIWTPRENDTITIYSTINHSKESKPTFSRATALDNVV

SEQ ID NO: 63683 - protein, 331 aa, Homo sapiens
MLWLFQSLLFVFCFGPGNVVSQSSLTPLMVNGILGESVTLPLEFPAGEKVNFITWLFNETSLAFIVPHETKSPEIHVTNPKQGKRLNFTQSYSLQLSNLKMEDTGSYRAQISTKTSAKLSSYTLRILRQLRNIQVTNHSQLFQNMTCELHLTCSVEDADDNVSFRWEALGNTLSSQPNLTVSWDPRISSEQDYTCIAENAVSNLSFSVSAQKLCEDVKIQYTDTKMILFMVSGICIVFGFIILLLLVLRKRRDSLSLSTQRTQGPESARNLEYVSVSPTNNTVYASVTHSNRETEIWTPRENDTITIYSTINHSKESKPTFSRATALDNVV

SEQ ID NO: 63684 - protein, 296 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEENNPKGRSSKYGLLHCGNTEKDGKSPLTAHDARHTKAICL

SEQ ID NO: 63685 - protein, 228 aa, Homo sapiens
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 63686 - protein, 335 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 63687 - protein, 204 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEYIEEKKRVDICRETPNICPHSGENTEYDTIPHTNRTILKEDPANTVYSTVEIPKKMENPHSLLTMPDTPRLFAYENVI

SEQ ID NO: 63688 - protein, 165 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYENNPKGRSSKYGLLHCGNTEKDGKSPLTAHDARHTKAICL

SEQ ID NO: 63689 - protein, 149 aa, Homo sapiens
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEENNPKGRSSKYGLLHCGNTEKDGKSPLTAHDARHTKAICL

SEQ ID NO: 63690 - protein, 188 aa, Homo sapiens
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEEYIEEKKRVDICRETPNICPHSGENTEYDTIPHTNRTILKEDPANTVYSTVEIPKKMENPHSLLTMPDTPRLFAYENVI

SEQ ID NO: 63691 - protein, 285 aa, Homo sapiens
MVMRPLWSLLLWEALLPITVTGAQVLSKVGGSVLLVAARPPGFQVREAIWRSLWPSEELLATFFRGSLETLYHSRFLGRAQLHSNLSLELGPLESGDSGNFSVLMVDTRGQPWTQTLQLKVYDAVPRPVVQVFIAVERDAQPSKTCQVFLSCWAPNISEITYSWRRETTMDFGMEPHSLFTDGQVLSISLGPGDRDVAYSCIVSNPVSWDLATVTPWDSCHHEAAPGKASYKDVLLVVVPVSLLLMLVTLFSAWHWCPCSGKKKKDVHADRVGPETENPLVQDLP

SEQ ID NO: 63692 - protein, 176 aa, Homo sapiens
MVMRPLWSLLLWEDAVPRPVVQVFIAVERDAQPSKTCQVFLSCWAPNISEITYSWRRETTMDFGMEPHSLFTDGQVLSISLGPGDRDVAYSCIVSNPVSWDLATVTPWDSCHHEAAPGKASYKDVLLVVVPVSLLLMLVTLFSAWHWCPCSGKKKKDVHADRVGPETENPLVQDLP

SEQ ID NO: 63693 - protein, 147 aa, Homo sapiens
MGGRHHLQRQVSESMSALFQAVRLESAWADRVRYMVVVYSSGRQDTEENILLGVDFSSKESGFSVSTAGRMHIFKPVSVQAMWSALQVLHKACEVARRHNYFPGGVALIWATYYESCISSEQSCINEWNAMQDLESTRPDSPALFVD

SEQ ID NO: 63694 - protein, 703 aa, Homo sapiens
MARARRAVVGSVRDVSTAATNLFYFTDFCIFLQPTHCFCCPEVSSSNYLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDKPTEGERTERLIKAKLRSIMMSQDLENVTSKEIRNELEKQMNCNLKELKEFIDNEMLLILGQMDKPSLIFDHLYLGSEWNASNLEELQGSGVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEVGRARPAGWHTPSLPSHSNWPTSASVVGTTGTRHHTQLIFFYCLLWAPSSHLQGPEGSFTG

SEQ ID NO: 63695 - protein, 1049 aa, Homo sapiens
MALVTLQRSPTPSAASSSASNSELEAGSEEDRKLNLSLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDKPTEGERTERLIKAKLRSIMMSQDLENVTSKEIRNELEKQMNCNLKELKEFIDNEMLLILGQMDKPSLIFDHLYLGSEWNASNLEELQGSGVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEDDAIFGILNKVKPSYKSCADCMYPTASGAPEASRERCEDPNAPAICTQPAFLPHITSSPVAHLASRSRVPEKPASGPTEPPPFLPPAGSRRADTSGPGAGAALEPPASLLEPSRETPKVLPKSLLLKNSHCDKNPPSTEVVIKEESSPKKDMKPAKDLRLLFSNESEKPTTNSYLMQHQESIIQLQKAGLVRKHTKELERLKSVPADPAPPSRDGPASRLEASIPEESQDPAALHELGPLVMPSQAGSDEKSEAAPASLEGGSLKSPPPFFYRLDHTSSFSKDFLKTICYTPTSSSMSSNLTRSSSSDSIHSVRGKPGLVKQRTQEIETRLRLAGLTVSSPLKRSHSLAKLGSLTFSTEDLSSEADPSTVADSQDTTLSESSFLHEPQGTPRDPAATSKPSGKPAPENLKSPSWMSKS

SEQ ID NO: 63696 - protein, 737 aa, Homo sapiens
MRCYLSWDRWTSPPLSSIIFISVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEDDAIFGILNKVKPSYKSCADCMYPTASGAPEASRERCEDPNAPAICTQPAFLPHITSSPVAHLASRSRVPEKPASGPTEPPPFLPPAGSRRADTSGPGAGAALEPPASLLEPSRETPKVLPKSLLLKNSHCDKNPPSTEVVIKEESSPKKDMKPAKDLRLLFSNESEKPTTNSYLMQHQESIIQLQKAGLVRKHTKELERLKSVPADPAPPSRDGPASRLEASIPEESQDPAALHELGPLVMPSQAGSDEKSEAAPASLEGGSLKSPPPFFYRLDHTSSFSKDFLKTICYTPTSSSMSSNLTRSSSSDSIHSVRGKPGLVKQRTQEIETRLRLAGLTVSSPLKRSHSLAKLGSLTFSTEDLSSEADPSTVADSQDTTLSESSFLHEPQGTPRDPAATSKPSGKPAPENLKSPSWMSKS

SEQ ID NO: 63697 - protein, 692 aa, Homo sapiens
MALVTLQRSPTPSAASSSASNSELEAGSEEDRKLNLSLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDKPTEGERTERLIKAKLRSIMMSQDLENVTSKEIRNELEKQMNCNLKELKEFIDNEMLLILGQMDKPSLIFDHLYLGSEWNASNLEELQGSGVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEVGRARPAGWHTPSLPSHSNWPTSASVVGTTGTRHHTQLIFFYCLLWAPSSHLQGPEGSFTG

SEQ ID NO: 63698 - protein, 1423 aa, Homo sapiens
MALVTVQRSPTPSTTSSPCASEADSGEEECRSQPRSISESFLTVKGAALFLPRGNGSSTPRISHRRNKHAGDLQQHLQAMFILLRPEDNIRLAVRLESTYQNRTRYMVVVSTNGRQDTEESIVLGMDFSSNDSSTCTMGLVLPLWSDTLIHLDGDGGFSVSTDNRVHIFKPVSVQAMWSALQSLHKACEVARAHNYYPGSLFLTWVSYYESHINSDQSSVNEWNAMQDVQSHRPDSPALFTDIPTERERTERLIKTKLREIMMQKDLENITSKEIRTELEMQMVCNLREFKEFIDNEMIVILGQMDSPTQIFEHVFLGSEWNASNLEDLQNRGVRYILNVTREIDNFFPGVFEYHNIRVYDEEATDLLAYWNDTYKFISKAKKHGSKCLVHCKMGVSRSASTVIAYAMKEYGWNLDRAYDYVKERRTVTKPNPSFMRQLEEYQGILLASKQRHNKLWRSHSDSDLSDHHEPICKPGLELNKKDITTSADQIAEVKTMESHPPIPPVFVEHMVPQDANQKGLCTKERMICLEFTSREFHAGQIEDELNLNDINGCSSGCCLNESKFPLDNCHASKALIQPGHVPEMANKFPDLTVEDLETDALKADMNVHLLPMEELTSPLKDPPMSPDPESPSPQPSCQTEISDFSTDRIDFFSALEKFVELSQETRSRSFSHSRMEELGGGRNESCRLSVVEVAPSKVTADDQRSSSLSNTPHASEESSMDEEQSKAISELVSPDIFMQSHSENAISVKEIVTEIESISQGVGQIQLKGDILPNPCHTPKKNSIHELLLERAQTPENKPGHMEQDEDSCTAQPELAKDSGMCNPEGCLTTHSSIADLEEGEPAEGEQELQGSGMHPGAKWYPGSVRRATLEFEERLRQEQEHHGAAPTCTSLSTRKNSKNDSSVADLAPKGKSDEAPPEHSFVLKEPEMSKGKGKYSGSEAGSLSHSEQNATVPAPRVLEFDHLPDPQEGPGSDTGTQQEGVLKDLRTVIPYQESETQAVPLPLPKRVEIIEYTHIVTSPNHTGPGSEIATSEKSGEQGLRKVNMEKSVTVLCTLDENLNRTLDPNQVSLHPQVLPLPHSSSPEHNRPTDHPTSILSSPEDRGSSLSTALETAAPFVSHTTHLLSASLDYLHPQTMVHLEGFTEQSSTTDEPSAEQVSWEESQESPLSSGSEVPYKDSQLSSADLSLISKLGDNTGELQEKMDPLPVACRLPHSSSSENIKSLSHSPGVVKERAKEIESRVVFQAGLTKPSQMRRSASLAKLGYLDLCKDCLPEREPASCESPHLKLLQPFLRTDSGMHAMEDQESLENPGAPHNPEPTKSFVEQLTTTECIVQSKPVERPLVQYAKEFGSSQQYLLPRAGLELTSSEGGLPVLQTQGLQCACPAPGLAVAPRQQHGRTHPLRRLKKANDKKRTTNPFYNTM

SEQ ID NO: 63699 - protein, 202 aa, Homo sapiens
MTLSTLARKRKAPLACTCSLGGPDMIPYFSANAVISQNAINQLISESFLTVKGAALFLPRGNGSSTPRISHRRNKHAGDLQQHLQAMFILLRPEDNIRLAVRLESTYQNRTRYMVVVSTNGRQDTEESIVLGMDFSSNDSSTCTMGLVLPLWSDTLIHLDGDGGFSVSTDNRVHIFKPVSVQAMWVDRDSRNKHCDVLLVEE

SEQ ID NO: 63700 - protein, 449 aa, Homo sapiens
MALVTVQRSPTPSTTSSPCASEADSGEEECRSQPRSISESFLTVKGAALFLPRGNGSSTPRISHRRNKHAGDLQQHLQAMFILLRPEDNIRLAVRLESTYQNRTRYMVVVSTNGRQDTEESIVLGMDFSSNDSSTCTMGLVLPLWSDTLIHLDGDGGFSVSTDNRVHIFKPVSVQAMWSALQSLHKACEVARAHNYYPGSLFLTWVSYYESHINSDQSSVNEWNAMQDVQSHRPDSPALFTDIPTERERTERLIKTKLREIMMQKDLENITSKEIRTELEMQMVCNLREFKEFIDNEMIVILGQMDSPTQIFEHVFLGSEWNASNLEDLQNRGVRYILNVTREIDNFFPGVFEYHNIRVYDEEATDLLAYWNDTYKFISKAKKHGSKCLVHCKMGVSRSASTVIAYAMKEYGWNLDRAYDYVKERRTVTKPNPSFMRQLEEYQGILLAR

SEQ ID NO: 63701 - protein, 1450 aa, Homo sapiens
MALVTVQRSPTPSTTSSPCASSSHLEDSESAALLCCECEESEIFTDSNEADSGEEECRSQPRSISESFLTVKGAALFLPRGNGSSTPRISHRRNKHAGDLQQHLQAMFILLRPEDNIRLAVRLESTYQNRTRYMVVVSTNGRQDTEESIVLGMDFSSNDSSTCTMGLVLPLWSDTLIHLDGDGGFSVSTDNRVHIFKPVSVQAMWSALQSLHKACEVARAHNYYPGSLFLTWVSYYESHINSDQSSVNEWNAMQDVQSHRPDSPALFTDIPTERERTERLIKTKLREIMMQKDLENITSKEIRTELEMQMVCNLREFKEFIDNEMIVILGQMDSPTQIFEHVFLGSEWNASNLEDLQNRGVRYILNVTREIDNFFPGVFEYHNIRVYDEEATDLLAYWNDTYKFISKAKKHGSKCLVHCKMGVSRSASTVIAYAMKEYGWNLDRAYDYVKERRTVTKPNPSFMRQLEEYQGILLASKQRHNKLWRSHSDSDLSDHHEPICKPGLELNKKDITTSADQIAEVKTMESHPPIPPVFVEHMVPQDANQKGLCTKERMICLEFTSREFHAGQIEDELNLNDINGCSSGCCLNESKFPLDNCHASKALIQPGHVPEMANKFPDLTVEDLETDALKADMNVHLLPMEELTSPLKDPPMSPDPESPSPQPSCQTEISDFSTDRIDFFSALEKFVELSQETRSRSFSHSRMEELGGGRNESCRLSVVEVAPSKVTADDQRSSSLSNTPHASEESSMDEEQSKAISELVSPDIFMQSHSENAISVKEIVTEIESISQGVGQIQLKGDILPNPCHTPKKNSIHELLLERAQTPENKPGHMEQDEDSCTAQPELAKDSGMCNPEGCLTTHSSIADLEEGEPAEGEQELQGSGMHPGAKWYPGSVRRATLEFEERLRQEQEHHGAAPTCTSLSTRKNSKNDSSVADLAPKGKSDEAPPEHSFVLKEPEMSKGKGKYSGSEAGSLSHSEQNATVPAPRVLEFDHLPDPQEGPGSDTGTQQEGVLKDLRTVIPYQESETQAVPLPLPKRVEIIEYTHIVTSPNHTGPGSEIATSEKSGEQGLRKVNMEKSVTVLCTLDENLNRTLDPNQVSLHPQVLPLPHSSSPEHNRPTDHPTSILSSPEDRGSSLSTALETAAPFVSHTTHLLSASLDYLHPQTMVHLEGFTEQSSTTDEPSAEQVSWEESQESPLSSGSEVPYKDSQLSSADLSLISKLGDNTGELQEKMDPLPVACRLPHSSSSENIKSLSHSPGVVKERAKEIESRVVFQAGLTKPSQMRRSASLAKLGYLDLCKDCLPEREPASCESPHLKLLQPFLRTDSGMHAMEDQESLENPGAPHNPEPTKSFVEQLTTTECIVQSKPVERPLVQYAKEFGSSQQYLLPRAGLELTSSEGGLPVLQTQGLQCACPAPGLAVAPRQQHGRTHPLRRLKKANDKKRTTNPFYNTM

SEQ ID NO: 63702 - protein, 659 aa, Homo sapiens
MALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 63703 - protein, 696 aa, Homo sapiens
MLLWILLLETSLCFAAGNVTGDVCKEKICSCNEIEGDLHVDCEKKGFTSLQRFTAPTSQFYHLFLHGNSLTRLFPNEFANFYNAVSLHMENNGLHEIVPGAFLGLQLVKRLHINNNKIKSFRKQTFLGLDDLEYLQADFNLLRDIDPGAFQDLNKLEVLILNDNLISTLPANVFQYVPITHLDLRGNRLKTLPYEEVLEQIPGIAEILLEDNPWDCTCDLLSLKEWLENIPKNALIGRVVCEAPTRLQGKDLNETTEQDLCPLKNRVDSSLPAPPAQEETFAPGPLPTPFKTNGQEDHATPGSAPNGGTKIPGNWQIKIRPTAAIATGSSRNKPLANSLPCPGGCSCDHIPGSGLKMNCNNRNVSSLADLKPKLSNVQELFLRDNKIHSIRKSHFVDYKNLILLDLGNNNIATVENNTFKNLLDLRWLYMDSNYLDTLSREKFAGLQNLEYLNVEYNAIQLILPGTFNAMPKLRILILNNNLLRSLPVDVFAGVSLSKLSLHNNYFMYLPVAGVLDQLTSIIQIDLHGNPWECSCTIVPFKQWAERLGSEVLMSDLKCETPVNFFRKDFMLLSNDEICPQLYARISPTLTSHSKNSTGLAETGTHSNSYLDTSRVSISVLVPGLLLVFVTSAFTVVGMLVFILRNRKRSKRRDANSSASEINSLQTVCDSSYWHNGPYNADGAHRVYDCGSHSLSD

SEQ ID NO: 63704 - protein, 724 aa, Homo sapiens
MLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGNRLKVMPFAGVLEHIGGIMEIQLEENPWNCTCDLLPLKAWLDTITVFVGEIVCETPFRLHGKDVTQLTRQDLCPRKSASDSSQRGSHADTHVQRLSPTMNPALNPTRAPKASRPPKMRNRPTPRVTVSKDRQSFGPIMVYQTKSPVPLTCPSSCVCTSQSSDNGLNVNCQERKFTNISDLQPKPTSPKKLYLTGNYLQTVYKNDLLEYSSLDLLHLGNNRIAVIQEGAFTNLTSLRRLYLNGNYLEVLYPSMFDGLQSLQYLYLEYNVIKEIKPLTFDALINLQLLFLNNNLLRSLPDNIFGGTALTRLNLRNNHFSHLPVKGVLDQLPAFIQIDLQENPWDCTCDIMGLKDWTEHANSPVIINEVTCESPAKHAGEILKFLGREAICPDSPNLSDGTVLSMNHNTDTPRSLSVSPSSYPELHTEVPLSVLILGLLVVFILSVCFGAGLFVFVLKRRKGVPSVPRNTNNLDVSSFQLQYGSYNTETHDKTDGHVYNYIPPPVGQMCQNPIYMQKEGDPVAYYRNLQEFSYSNLE

SEQ ID NO: 63705 - protein, 845 aa, Homo sapiens
MLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGNRLKVMPFAGVLEHIGGIMEIQLEENPWNCTCDLLPLKAWLDTITVFVGEIVCETPFRLHGKDVTQLTRQDLCPRKSASDSSQRGSHADTHVQRLSPTMNPALNPTRAPKASRPPKMRNRPTPRVTVSKDRQSFGPIMVYQTKSPVPLTCPSSCVCTSQSSDNGLNVNCQERKFTNISDLQPKPTSPKKLYLTGNYLQTVYKNDLLEYSSLDLLHLGNNRIAVIQEGAFTNLTSLRRLYLNGNYLEVLYPSMFDGLQSLQYLYLEYNVIKEIKPLTFDALINLQLLFLNNNLLRSLPDNIFGGTALTRLNLRNNHFSHLPVKGVLDQLPAFIQIDLQENPWDCTCDIMGLKDWTEHANSPVIINEVTCESPAKHAGEILKFLGREAICPDSPNLSDGTVLSMNHNTDTPRSLSVSPSSYPELHTEVPLSVLILGLLVVFILSVCFGAGLFVFVLKRRKGVPSVPRNTNNLDVSSFQLQYGSYNTETHDKTDGHVYNYIPPPVGQMCQNPIYMQKEGDPVAYYRNLQEFSYSNLEEKKEEPATPAYTISATELLEKQATPREPELLYQNIAERVKELPSAGLVHYNFCTLPKRQFAPSYESRRQNQDRINKTVLYGTPRKCFVGQSKPNHPLLQAKPQSEPDYLEVLEKQTAISQL

SEQ ID NO: 63706 - protein, 845 aa, Homo sapiens; identical to SEQ ID NO: 63705

SEQ ID NO: 63707 - protein, 845 aa, Homo sapiens; identical to SEQ ID NO: 63705

SEQ ID NO: 63708 - protein, 845 aa, Homo sapiens; identical to SEQ ID NO: 63705

SEQ ID NO: 63709 - protein, 845 aa, Homo sapiens; identical to SEQ ID NO: 63705

SEQ ID NO: 63710 - protein, 977 aa, Homo sapiens
MKPSIAEMLHRGRMLWIILLSTIALGWTTPIPLIEDSEEIDEPCFDPCYCEVKESLFHIHCDSKGFTNISQITEFWSRPFKLYLQRNSMRKLYTNSFLHLNNAVSINLGNNALQDIQTGAFNGLKILKRLYLHENKLDVFRNDTFLGLESLEYLQADYNVIKRIESGAFRNLSKLRVLILNDNLIPMLPTNLFKAVSLTHLDLRGNRLKVLFYRGMLDHIGRSLMELQLEENPWNCTCEIVQLKSWLERIPYTALVGDITCETPFHFHGKDLREIRKTELCPLLSDSEVEASLGIPHSSSSKENAWPTKPSSMLSSVHFTASSVEYKSSNKQPKPTKQPRTPRPPSTSQALYPGPNQPPIAPYQTRPPIPIICPTGCTCNLHINDLGLTVNCKERGFNNISELLPRPLNAKKLYLSSNLIQKIYRSDFWNFSSLDLLHLGNNRISYVQDGAFINLPNLKSLFLNGNDIEKLTPGMFRGLQSLHYLYFEFNVIREIQPAAFSLMPNLKLLFLNNNLLRTLPTDAFAGTSLARLNLRKNYFLYLPVAGVLEHLNAIVQIDLNENPWDCTCDLVPFKQWIETISSVSVVGDVLCRSPENLTHRDVRTIELEVLCPEMLHVAPAGESPAQPGDSHLIGAPTSASPYEFSPPGGPVPLSVLILSLLVLFFSAVFVAAGLFAYVLRRRRKKLPFRSKRQEGVDLTGIQMQCHRLFEDGGGGGGGSGGGGRPTLSSPEKAPPVGHVYEYIPHPVTQMCNNPIYKPREEEEVAVSSAQEAGSAERGGPGTQPPGMGEALLGSEQFAETPKENHSNYRTLLEKEKEWALAVSSSQLNTIVTVNHHHPHHPAVGGVSGVVGGTGGDLAGFRHHEKNGGVVLFPPGGGCGSGSMLLDRERPQPAPCTVGFVDCLYGTVPKLKELHVHPPGMQYPDLQQDARLKETLLFSAGKGFTDHQTQKSDYLELRAKLQTKPDYLEVLEKTTYRF

SEQ ID NO: 63711 - protein, 977 aa, Homo sapiens; identical to SEQ ID NO: 63710

SEQ ID NO: 63712 - protein, 163 aa, Homo sapiens
MKPSIAEMLHRGRMLWIILLSTIALGWTTPIPLIEDSEEIDEPCFDPCYCEVKESLFHIHCDSKGFTNISQITEFWSRPFKLYLQRNSMRKLYTNSFLHLNNAVSINLGNNALQDIQTGAFNGLKILKRLYLHENKLDVFRNDTFLGLESLEYLQADYNVIKR

SEQ ID NO: 63713 - protein, 837 aa, Homo sapiens
MFLWLFLILSALISSTNADSDISVEICNVCSCVSVENVLYVNCEKVSVYRPNQLKPPWSNFYHLNFQNNFLNILYPNTFLNFSHAVSLHLGNNKLQNIEGGAFLGLSALKQLHLNNNELKILRADTFLGIENLEYLQADYNLIKYIERGAFNKLHKLKVLILNDNLISFLPDNIFRFASLTHLDIRGNRIQKLPYIGVLEHIGRVVELQLEDNPWNCSCDLLPLKAWLENMPYNIYIGEAICETPSDLYGRLLKETNKQELCPMGTGSDFDVRILPPSQLENGYTTPNGHTTQTSLHRLVTKPPKTTNPSKISGIVAGKALSNRNLSQIVSYQTRVPPLTPCPAPCFCKTHPSDLGLSVNCQEKNIQSMSELIPKPLNAKKLHVNGNSIKDVDVSDFTDFEGLDLLHLGSNQITVIKGDVFHNLTNLRRLYLNGNQIERLYPEIFSGLHNLQYLYLEYNLIKEISAGTFDSMPNLQLLYLNNNLLKSLPVYIFSGAPLARLNLRNNKFMYLPVSGVLDQLQSLTQIDLEGNPWDCTCDLVALKLWVEKLSDGIVVKELKCETPVQFANIELKSLKNEILCPKLLNKPSAPFTSPAPAITFTTPLGPIRSPPGGPVPLSILILSILVVLILTVFVAFCLLVFVLRRNKKPTVKHEGLGNPDCGSMQLQLRKHDHKTNKKDGLSTEAFIPQTIEQMSKSHTCGLKESETGFMFSDPPGQKVVMRNVADKEKDLLHVDTRKRLSTIDELDELFPSRDSNVFIQNFLESKKEYNSIGVSGFEIRYPEKQPDKKSKKSLIGGNHSKIVVEQRKSEYFELKAKLQSSPDYLQVLEEQTALNKI

SEQ ID NO: 63714 - protein, 837 aa, Homo sapiens; identical to SEQ ID NO: 63713

SEQ ID NO: 63715 - protein, 837 aa, Homo sapiens; identical to SEQ ID NO: 63713

SEQ ID NO: 63716 - protein, 958 aa, Homo sapiens
MHTCCPPVTLEQDLHRKMHSWMLQTLAFAVTSLVLSCAETIDYYGEICDNACPCEEKDGILTVSCENRGIISLSEISPPRFPIYHLLLSGNLLNRLYPNEFVNYTGASILHLGSNVIQDIETGAFHGLRGLRRLHLNNNKLELLRDDTFLGLENLEYLQVDYNYISVIEPNAFGKLHLLQVLILNDNLLSSLPNNLFRFVPLTHLDLRGNRLKLLPYVGLLQHMDKVVELQLEENPWNCSCELISLKDWLDSISYSALVGDVVCETPFRLHGRDLDEVSKQELCPRRLISDYEMRPQTPLSTTGYLHTTPASVNSVATSSSAVYKPPLKPPKGTRQPNKPRVRPTSRQPSKDLGYSNYGPSIAYQTKSPVPLECPTACSCNLQISDLGLNVNCQERKIESIAELQPKPYNPKKMYLTENYIAVVRRTDFLEATGLDLLHLGNNRISMIQDRAFGDLTNLRRLYLNGNRIERLSPELFYGLQSLQYLFLQYNLIREIQSGTFDPVPNLQLLFLNNNLLQAMPSGVFSGLTLLRLNLRSNHFTSLPVSGVLDQLKSLIQIDLHDNPWDCTCDIVGMKLWVEQLKVGVLVDEVICKAPKKFAETDMRSIKSELLCPDYSDVVVSTPTPSSIQVPARTSAVTPAVRLNSTGAPASLGAGGGASSVPLSVLILSLLLVFIMSVFVAAGLFVLVMKRRKKNQSDHTSTNNSDVSSFNMQYSVYGGGGGTGGHPHAHVHHRGPALPKVKTPAGHVYEYIPHPLGHMCKNPIYRSREGNSVEDYKDLHELKVTYSSNHHLQQQQQPPPPPQQPQQQPPPQLQLQPGEEERRESHHLRSPAYSVSTIEPREDLLSPVQDADRFYRGILEPDKHCSTTPAGNSLPEYPKFPCSPAAYTFSPNYDLRRPHQYLHPGAGDSRLREPVLYSPPSAVFVEPNRNEYLELKAKLNVEPDYLEVLEKQTTFSQF

SEQ ID NO: 63717 - protein, 717 aa, Homo sapiens
MGAGKHREGGGGDPTSLNGCADLIQRRTEISRDLDEVSKQELCPRRLISDYEMRPQTPLSTTGYLHTTPASVNSVATSSSAVYKPPLKPPKGTRQPNKPRVRPTSRQPSKDLGYSNYGPSIAYQTKSPVPLECPTACSCNLQISDLGLNVNCQERKIESIAELQPKPYNPKKMYLTENYIAVVRRTDFLEATGLDLLHLGNNRISMIQDRAFGDLTNLRRLYLNGNRIERLSPELFYGLQSLQYLFLQYNLIREIQSGTFDPVPNLQLLFLNNNLLQAMPSGVFSGLTLLRLNLRSNHFTSLPVSGVLDQLKSLIQIDLHDNPWDCTCDIVGMKLWVEQLKVGVLVDEVICKAPKKFAETDMRSIKSELLCPDYSDVVVSTPTPSSIQVPARTSAVTPAVRLNSTGAPASLGAGGGASSVPLSVLILSLLLVFIMSVFVAAGLFVLVMKRRKKNQSDHTSTNNSDVSSFNMQYSVYGGGGGTGGHPHAHVHHRGPALPKVKTPAGHVYEYIPHPLGHMCKNPIYRSREGNSVEDYKDLHELKVTYSSNHHLQQQQQPPPPPQQPQQQPPPQLQLQPGEEERRESHHLRSPAYSVSTIEPREDLLSPVQDADRFYRGILEPDKHCSTTPAGNSLPEYPKFPCSPAAYTFSPNYDLRRPHQYLHPGAGDSRLREPVLYSPPSAVFVEPNRNEYLELKAKLNVEPDYLEVLEKQTTFSQF

SEQ ID NO: 63718 - protein, 841 aa, Homo sapiens
MKLWIHLFYSSLLACISLHSQTPVLSSRGSCDSLCNCEEKDGTMLINCEAKGIKMVSEISVPPSRPFQLSLLNNGLTMLHTNDFSGLTNAISIHLGFNNIADIEIGAFNGLGLLKQLHINHNSLEILKEDTFHGLENLEFLQADNNFITVIEPSAFSKLNRLKVLILNDNAIESLPPNIFRFVPLTHLDLRGNQLQTLPYVGFLEHIGRILDLQLEDNKWACNCDLLQLKTWLENMPPQSIIGDVVCNSPPFFKGSILSRLKKESICPTPPVYEEHEDPSGSLHLAATSSINDSRMSTKTTSILKLPTKAPGLIPYITKPSTQLPGPYCPIPCNCKVLSPSGLLIHCQERNIESLSDLRPPPQNPRKLILAGNIIHSLMKSDLVEYFTLEMLHLGNNRIEVLEEGSFMNLTRLQKLYLNGNHLTKLSKGMFLGLHNLEYLYLEYNAIKEILPGTFNPMPKLKVLYLNNNLLQVLPPHIFSGVPLTKVNLKTNQFTHLPVSNILDDLDLLTQIDLEDNPWDCSCDLVGLQQWIQKLSKNTVTDDILCTSPGHLDKKELKALNSEILCPGLVNNPSMPTQTSYLMVTTPATTTNTADTILRSLTDAVPLSVLILGLLIMFITIVFCAAGIVVLVLHRRRRYKKKQVDEQMRDNSPVHLQYSMYGHKTTHHTTERPSASLYEQHMVSPMVHVYRSPSFGPKHLEEEEERNEKEGSDAKHLQRSLLEQENHSPLTGSNMKYKTTNQSTEFLSFQDASSLYRNILEKERELQQLGITEYLRKNIAQLQPDMEAHYPGAHEELKLMETLMYSRPRKVLVEQTKNEYFELKANLHAEPDYLEVLEQQT

SEQ ID NO: 63719 - protein, 1525 aa, Homo sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGKGEGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 63720 - protein, 1521 aa, Homo sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 63721 - protein, 1525 aa, Homo sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSDEEEGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 63722 - protein, 1529 aa, Homo sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSAKEQYFIPGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 63723 - protein, 1472 aa, Homo sapiens
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIVKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQVFRAQVFQSSLPGNCSWSCWPPRPPMP

SEQ ID NO: 63724 - protein, 1523 aa, Homo sapiens
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIVKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 63725 - protein, 1085 aa, Homo sapiens
MSTPSRFKKDKEIIAEYESQVKEIRAQLVEQQKCLEQQTEMRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVKKTTEATLQTIQDMVTIEDYDVSECFQHSRSTESVKSTVSETYLSKPSIAKRRANQQETEQFYFMKLREYLEGSNLITKLQAKHDLLQRTLGEGHRAEYMTTRPPNVPPKPQKHRKSRPRSQYNTKLFNGDLETFVKDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDECEPIEAIAKFDYVGRSARELSFKKGASLLLYHRASEDWWEGRHNGIDGLVPHQYIVVQDMDDTFSDTLSQKADSEASSGPVTEDKSSSKDMNSPTDRHPDGYLARQRKRGEPPPPVRRPGRTSDGHCPLHPPHALSNSSVDLGSPSLASHPRGLLQNRGLNNDSPERRRRPGHGSLTNISRHDSLKKIDSPPIRRSTSSGQYTGFNDHKPLDPETIAQDIEETMNTALNELRELERQSTAKHAPDVVLDTLEQVKNSPTPATSTESLSPLHNVALRSSEPQIRRSTSSSSDTMSTFKPMVAPRMGVQLKPPALRPKPAVLPKTNPTIGPAPPPQGPTDKSCTM

SEQ ID NO: 63726 - protein, 1062 aa, Homo sapiens
MSTPSRFKKDKEIIAEYESQVKEIRAQLVEQQKCLEQQTEMRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVKKTTEATLQTIQDMVTIEDYDVSECFQHSRSTESVKSTVSETYLSKPSIAKRRANQQETEQFYFMKLREYLEGSNLITKLQAKHDLLQRTLGEGHRAEYMTTSRGRRNSHTRHQDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDECEPIEAIAKFDYVGRSARELSFKKGASLLLYHRASEDWWEGRHNGIDGLVPHQYIVVQDMDDTFSDTLSQKADSEASSGPVTEDKSSSKDMNSPTDRHPDGYLARQRKRGEPPPPVRRPGRTSDGHCPLHPPHALSNSSVDLGSPSLASHPRGLLQNRGLNNDSPERRRRPGHGSLTNISRHDSLKKIDSPPIRRSTSSGQYTGFNDHKPLDPETIAQDIEETMNTALNELRELERQSTAKHAPDVVLDTLEQVKNSPTPATSTESLSPLHNVALRSSEPQIRRSTSSSSDTMSTFKPMVAPRMGVQLKPPALRPKPAVLPKTNPTIGPAPPPQGPTDKSCTM

SEQ ID NO: 63727 - protein, 985 aa, Homo sapiens
  MOD_RES (1)..(1): Any amino acid
XKDQNVLSPVNCWNLLLNQVKRESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINKQRKRPESGSIRKTFRSDSHGLSSSLTDSSSPGVGASCRPSSQPIMSQSLPKEGPDKCSISGHGSLNSISRHSSLKNRLDSPQIRKTATAGRSKSFNNHRPMDPEVIAQDIEATMNSALNELRELERQSSVKHTPDVVLDTLEPLKTSPVVAPTSEPSSPLHTQLLKDPEPAFQRSASTAGDIACAFRPVKSVKMAAPVKPPATRPKPTVFPKTNATSPGVNSSTSPQSTDKSCTV

SEQ ID NO: 63728 - protein, 931 aa, Homo sapiens
QSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINKQRKRPESGSIRKTFRSDSHGLSSSLTDSSSPGVGASCRPSSQPIMSQSLPKEGPDKCSISGHGSLNSISRHSSLKNRLDSPQIRKTATAGRSKSFNNHRPMDPEVIAQDIEATMNSALNELRELERQSSVKHTPDVVLDTLEPLKTSPVVAPTSEPSSPLHTQLLKDPEPAFQRSASTAGDIACAFRPVKSVKMAAPVKPPATRPKPTVFPKTNATSPGVNSSTSPQSTDKSCTV

SEQ ID NO: 63729 - protein, 703 aa, Homo sapiens
RKDQNVLSPVNCWNLLLNQVKRESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTLIS

SEQ ID NO: 63730 - protein, 252 aa, Homo sapiens
MEDYCDSPHGETTSVEDSTQDVTAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINNNLHLDNTKPVTTKQRKRPESGSIRKTFRSDSHGLSSSLTDSSSPGVGASCRPSSQPIMSQSLPKEGPDKCSISGHGSLNSISRHSSLKNRLDSPQIRKTATAGRSKSFNNH

SEQ ID NO: 63731 - protein, 230 aa, Homo sapiens
  MOD_RES (1)..(1): Any amino acid
XAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINNNLHLDNTKPVTTKQRKRPESGSIRKTFRSDSHGLSSSLTDSSSPGVGASCRPSSQPIMSQSLPKEGPDKCSISGHGSLNSISRHSSLKNRLDSPQIRKTATAGRSKSFNNH

SEQ ID NO: 63732 - protein, 450 aa, Homo sapiens
VKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINK

SEQ ID NO: 63733 - protein, 1075 aa, Homo sapiens
MSSQTKFKKDKEIIAEYEAQIKEIRTQLVEQFKCLEQQSESRLQLLQDLQEFFRRKAEIELEYSRSLEKLAERFSSKIRSSREHQFKKDQYLLSPVNCWYLVLHQTRRESRDHATLNDIFMNNVIVRLSQISEDVIRLFKKSKEIGLQMHEELLKVTNELYTVMKTYHMYHAESISAESKLKEAEKQEEKQFNKSGDLSMNLLRHEDRPQRRSSVKKIEKMKEKRQAKYSENKLKCTKARNDYLLNLAATNAAISKYYIHDVSDLIDCCDLGFHASLARTFRTYLSAEYNLETSRHEGLDVIENAVDNLDSRSDKHTVMDMCNQVFCPPLKFEFQPHMGDEVCQVSAQQPVQTELLMRYHQLQSRLATLKIENEEVRKTLDATMQTLQDMLTVEDFDVSDAFQHSRSTESVKSAASETYMSKINIAKRRANQQETEMFYFTKFKEYVNGSNLITKLQAKHDLLKQTLGEGERAECGTTRGRRNARTRNQDSGQAIPLVVESCIRYINLYGLQQQGIFRVPGSQVEVNDIKNSFERGEDPLVDDQNERDINSVAGVLKLYFRGLENPLFPKERFQDLISTIKLENPAERVHQIQQILVTLPRVVIVVMRYLFAFLNHLSQYSDENMMDPYNLAICFGPTLMHIPDGQDPVSCQAHINEVIKTIIIHHEAIFPSPRELEGPVYEKCMAGGEEYCDSPHSEPGAIDEVDHDNGTEPHTSDEEVEQIEAIAKFDYMGRSPRELSFKKGASLLLYHRASEDWWEGRHNGVDGLIPHQYIVVQDMDDAFSDSLSQKADSEASSGPLLDDKASSKNDLQSPTEHISDYGFGGVMGRVRLRSDGAAIPRRRSGGDTHSPPRGLGPSIDTPPRAAACPSSPHKIPLTRGRIESPEKRRMATFGSAGSINYPDKKALSEGHSMRSTCGSTRHSSLGDHKSLEAEALAEDIEKTMSTALHELRELERQNTVKQAPDVVLDTLEPLKNPPGPVSSEPASPLHTIVIRDPDAAMRRSSSSSTEMMTTFKPALSARLAGAQLRPPPMRPVRPVVQHRSSSSSSSGVGSPAVTPTEKMFPNSSADKSGTM

SEQ ID NO: 63734 - protein, 1099 aa, Homo sapiens
MSSQTKFKKDKEIIAEYEAQIKEIRTQLVEQFKCLEQQSESRLQLLQDLQEFFRRKAEIELEYSRSLEKLAERFSSKIRSSREHQFKKDQYLLSPVNCWYLVLHQTRRESRDHATLNDIFMNNVIVRLSQISEDVIRLFKKSKEIGLQMHEELLKVTNELYTVMKTYHMYHAESISAESKLKEAEKQEEKQFNKSGDLSMNLLRHEDRPQRRSSVKKIEKMKEKRQAKYSENKLKCTKARNDYLLNLAATNAAISKYYIHDVSDLIDCCDLGFHASLARTFRTYLSAEYNLETSRHEGLDVIENAVDNLDSRSDKHTVMDMCNQVFCPPLKFEFQPHMGDEVCQVSAQQPVQTELLMRYHQLQSRLATLKIENEEVRKTLDATMQTLQDMLTVEDFDVSDAFQHSRSTESVKSAASETYMSKINIAKRRANQQETEMFYFTKFKEYVNGSNLITKLQAKHDLLKQTLGEGERAECGTTRPPCLPPKPQKMRRPRPLSVYSHKLFNGSMEAFIKDSGQAIPLVVESCIRYINLYGLQQQGIFRVPGSQVEVNDIKNSFERGEDPLVDDQNERDINSVAGVLKLYFRGLENPLFPKERFQDLISTIKLENPAERVHQIQQILVTLPRVVIVVMRYLFAFLNHLSQYSDENMMDPYNLAICFGPTLMHIPDGQDPVSCQAHINEVIKTIIIHHEAIFPSPRELEGPVYEKCMAGGEEYCDSPHSEPGAIDEVDHDNGTEPHTSDEEVEQIEAIAKFDYMGRSPRELSFKKGASLLLYHRASEDWWEGRHNGVDGLIPHQYIVVQDMDDAFSDSLSQKADSEASSGPLLDDKASSKNDLQSPTEHISDYGFGGVMGRVRLRSDGAAIPRRRSGGDTHSPPRGLGPSIDTPPRAAACPSSPHKIPLTRGRIESPEKRRMATFGSAGSINYPDKKALSEGHSMRSTCGSTRHSSLGDHKSLEAEALAEDIEKTMSTALHELRELERQNTVKQAPDVVLDTLEPLKNPPGPVSSEPASPLHTIVIRDPDAAMRRSSSSSTEMMTTFKPALSARLAGAQLRPPPMRPVRPVVQHRSSSSSSSGVGSPAVTPTEKMFPNSSADKSGTM

SEQ ID NO: 63735 - protein, 335 aa, Homo sapiens
MNNVIVRLSQISEDVIRLFKKSKEIGLQMHEELLKVTNELYTVMKTYHMYHAESISAESKLKEAEKQEEKQFNKSGDLSMNLLRHEDRPQRRSSVKKIEKMKEKRQAKYSENKLKCTKARNDYLLNLAATNAAISKYYIHDVSDLIDCCDLGFHASLARTFRTYLSAEYNLETSRHEGLDVIENAVDNLDSRSDKHTVMDMCNQVFCPPLKFEFQPHMGDEVCQVSAQQPVQTELLMRYHQLQSRLATLKIENEEVRKTLDATMQTLQDMLTVEDFDVSDAFQHSRSTESVKSAASETYMSKINIAKRRANQQETEMFYFTKGPDDVFPICHPRL

SEQ ID NO: 63736 - protein, 119 aa, Homo sapiens
MSWWRNNFWIILAVAIIVVSVGLGLILYCVCKWQLRRGKKWEIAKPLKHKQVDEEKMYDFLLLRTACSLPPLPLHYRTSMTETYGVLLCRPGWSALARSRLTAASASWVQAILLPQPPK

SEQ ID NO: 63737 - protein, 145 aa, Homo sapiens
MDTFTVQDSTAMSWWRNNFWIILAVAIIVVSVGLGLILYCVCKWQLRRGKKWEIAKPLKHKQVDEEKMYENVLNESPVQLPPLPPRNWPSLEDSSPQEAPSQPPATYSLVNKVKNKKTVSIPSYIEPEDDYDDVEIPANTEKASF

SEQ ID NO: 63738 - protein, 145 aa, Homo sapiens; identical to SEQ ID NO: 63737

SEQ ID NO: 63739 - protein, 465 aa, Homo sapiens
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESPVLPPVLVPRHSEYNPQHSLLAQFRNLGQNEPHMPLNATFPDSFQQPNSHPFPHSPNSSYPNSPGSSSSTYPHSPTSSDPGSPFQMPADTPPPAYLPPEDPMTQDGSQPMDTNMMAPPLPSEINRGDVQAVAYEEPKHWCSIVYYELNNRVGEAFHASSTSVLVDGFTDPSNNKNRFCLGLLSNVNRNSTIENTRRHIGKGVHLYYVGGEVYAECLSDSSIFVQSRNCNYHHGFHPTTVCKIPSGCSLKIFNNQEFAQLLAQSVNHGFETVYELTKMCTIRMSFVKGWGAEYHRQDVTSTPCWIEIHLHGPLQWLDKVLTQMGSPHNPISSVS

SEQ ID NO: 63740 - protein, 465 aa, Homo sapiens; identical to SEQ ID NO: 63739

SEQ ID NO: 63741 - protein, 58 aa, Homo sapiens
MNVTSLFSFTSPAVKRLLGWKQGDEEEKWAEKAVDALVKKLKKKKGAMEELEKALSCP

SEQ ID NO: 63742 - protein, 10 aa, Homo sapiens
MNVTSLFSFT

SEQ ID NO: 63743 - protein, 95 aa, Homo sapiens
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWP

SEQ ID NO: 63744 - protein, 133 aa, Homo sapiens
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESP

SEQ ID NO: 63745 - protein, 106 aa, Homo sapiens
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPL

SEQ ID NO: 63746 - protein, 112 aa, Homo sapiens
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFP

SEQ ID NO: 63747 - protein, 465 aa, Homo sapiens; identical to SEQ ID NO: 63739

SEQ ID NO: 63748 - protein, 552 aa, Homo sapiens
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 63749 - protein, 552 aa, Homo sapiens; identical to SEQ ID NO: 63748

SEQ ID NO: 63750 - protein, 177 aa, Homo sapiens
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNENNWYFSQLLLDLDKGMIQEQAIHGP

SEQ ID NO: 63751 - protein, 436 aa, Homo sapiens
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIK

SEQ ID NO: 63752 - protein, 80 aa, Homo sapiens
MTSMASLFSFTSPAVKRLLGWKQGDEEEKWAEKAVDALVKKLKKKKGAMEELEKALSSPGQPSKCVTIPRSLDGRLQVSH

SEQ ID NO: 63753 - protein, 128 aa, Homo sapiens
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHY

SEQ ID NO: 63754 - protein, 1 aa, Homo sapiens
M

SEQ ID NO: 63755 - protein, 134 aa, Homo sapiens
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESP

SEQ ID NO: 63756 - protein, 1 aa, Homo sapiens
M

SEQ ID NO: 63757 - protein, 464 aa, Homo sapiens
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESPVLPPVLVPRHNEFNPQHSLLVQFRNLSHNEPHMPQNATFPDSFHQPNNTPFPLSPNSPYPPSPASSTYPNSPASSGPGSPFQLPADTPPPAYMPPDDQMGQDNSQPMDTSNNMIPQIMPSISSRDVQPVAYEEPKHWCSIVYYELNNRVGEAFHASSTSVLVDGFTDPSNNKSRFCLGLLSNVNRNSTIENTRRHIGKGVHLYYVGGEVYAECLSDSSIFVQSRNCNFHHGFHPTTVCKIPSSCSLKIFNNQEFAQLLAQSVNHGFEAVYELTKMCTIRMSFVKGWGAEYHRQDVTSTPCWIEILHGPLQWLDKVLTQMGSPLNPISSVS

SEQ ID NO: 63758 - protein, 464 aa, Homo sapiens; identical to SEQ ID NO: 63757

SEQ ID NO: 63759 - protein, 496 aa, Homo sapiens
MFRSKRSGLVRRLWRSRVVPDREEGGSGGGGGGDEDGSLGSRAEPAPRAREGGGCGRSEVRPVAPRRPRDAVGQRGAQGAGRRRRAGGPPRPMSEPGAGAGSSLLDVAEPGGPGWLPESDCETVTCCLFSERDAAGAPRDASDPLAGAALEPAGGGRSREARSRLLLLEQELKTVTYSLLKRLKERSLDTLLEAVESRGGVPGGCVLVPRADLRLGGQPAPPQLLLGRLFRWPDLQHAVELKPLCGCHSFAAAADGPTVCCNPYHFSRLCGPESPPPPYSRLSPRDEYKPLDLSDSTLSYTETEATNSLITAPGEFSDASMSPDATKPSHWCSVAYWEHRTRVGRLYAVYDQAVSIFYDLPQGSGFCLGQLNLEQRSESVRRTRSKIGFGILLSKEPDGVWAYNRGEHPIFVNSPTLDAPGGRALVVRKVPPGYSIKVFDFERSGLQHAPEPDAADGPYDPNSVRISFAKGWGPCYSRQFITSCPCWLEILLNNPR

SEQ ID NO: 63760 - protein, 235 aa, Homo sapiens
MSRMGKPIETQKSPPPPYSRLSPRDEYKPLDLSDSTLSYTETEATNSLITAPGEFSDASMSPDATKPSHWCSVAYWEHRTRVGRLYAVYDQAVSIFYDLPQGSGFCLGQLNLEQRSESVRRTRSKIGFGILLSKEPDGVWAYNRGEHPIFVNSPTLDAPGGRALVVRKVPPGYSIKVFDFERSGLQHAPEPDAADGPYDPNSVRISFAKGWGPCYSRQFITSCPCWLEILLNNPR

SEQ ID NO: 63761 - protein, 338 aa, Homo sapiens
MFRSKRSGLVRRLWRSRVVPDREEGGSGGGGGGDEDGSLGSRAEPAPRAREGGGCGRSEVRPVAPRRPRDAVGQRGAQGAGRRRRAGGPPRPMSEPGAGAGSSLLDVAEPGGPGWLPESDCETVTCCLFSERDAAGAPRDASDPLAGAALEPAGGGRSREARSRLLLLEQELKTVTYSLLKRLKERSLDTLLEAVESRGGVPGGCVLVPRADLRLGGQPAPPQLLLGRLFRWPDLQHAVELKPLCGCHSFAAAADGPTVCCNPYHFSRLCGPESPPPPYSRLSPRDEYKPLDLSDSTLSYTETEATNSLITAPGEFSAADAGIGSRGNRGLESSVPCS

SEQ ID NO: 63762 - protein, 430 aa, Homo sapiens
MHSTTPISSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQPPCSALPPSPSHAFSQSPCTASYPHSPGSPSEPESPYQHSDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVKGWGAEYHRQDVTSTPCWIEIHLHGPLQWLDKVLTQMGSPHNPISSVS

SEQ ID NO: 63763 - protein, 467 aa, Homo sapiens
MHSTTPISSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQPPCSALPPSPSHAFSQSPCTASYPHSPGSPSEPESPYQHSVDTPPLPYHATEASETQSGQPVDATADRHVVLSIPNGDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVKGWGAEYHRQDVTSTPCWIEIHLHGPLQWLDKVLTQMGSPHNPISSVS

SEQ ID NO: 63764 - protein, 467 aa, Homo sapiens; identical to SEQ ID NO: 63763

SEQ ID NO: 63765 - protein, 396 aa, Homo sapiens
MKAVKSERERGSRRRHRDGDVVLPAGVVVKQERLSPEVAPPAHRRPDHSGGSPSPPTSEPARSGHRGNRARGVSRSPPKKKNKASGRRSKSPRSKRNRSPHHSTVKVKQEREDHPRRGREDRQHREPSEQEHRRARNSDRDRHRGHSHQRRTSNERPGSGQGQGRDRDTQNLQAQEEEREFYNARRREHRQRNDVGGGGSESQELVPRPGGNNKEKEVPAKEKPSFELSGALLEDTNTFRGVVIKYSEPPEARIPKKRWRLYPFKNDEVLPVMYIHRQSAYLLGRHRRIADIPIDHPSCSKQHAVFQYRLVEYTRADGTVGRRVKPYIIDLGSGNGTFLNNKRIEPQRYYELKEKDVLKFGFSSREYVLLHESSDTSEIDRKDDEDEEEEEEVSDS

SEQ ID NO: 63766 - protein, 380 aa, Homo sapiens
MKAVKSEREGVVVKQERLSPEVAPPAHRRPDHSGGSPSPPTSEPARSGHRGNRARGVSRSPPKKKNKASGRRSKSPRSKRNRSPHHSTVKVKQEREDHPRRGREDRQHREPSEQEHRRARNSDRDRHRGHSHQRRTSNERPGSGQGQGRDRDTQNLQAQEEEREFYNARRREHRQRNDVGGGGSESQELVPRPGGNNKEKEVPAKEKPSFELSGALLEDTNTFRGVVIKYSEPPEARIPKKRWRLYPFKNDEVLPVMYIHRQSAYLLGRHRRIADIPIDHPSCSKQHAVFQYRLVEYTRADGTVGRRVKPYIIDLGSGNGTFLNNKRIEPQRYYELKEKDVLKFGFSSREYVLLHESSDTSEIDRKDDEDEEEEEEVSDS

SEQ ID NO: 63767 - protein, 757 aa, Homo sapiens
MSNPGTRRNGSSIKIRLTVLCAKNLAKKDFFRLPDPFAKIVVDGSGQCHSTDTVKNTLDPKWNQHYDLYVGKTDSITISVWNHKKIHKKQGAGFLGCVRLLSNAISRLKDTGYQRLDLCKLNPSDTDAVRGQIVVSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPSPSGTIPGGDAAFLYEFLLQGHTSEPRDLNSVNCDELGPLPPGWEVRSTVSGRIYFVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWILENDITPVLDHTFCVEHNAFGRILQHELKPNGRNVPVTEENKKEYVRLYVNWRFMRGIEAQFLALQKGFNELIPQHLLKPFDQKELELIIGGLDKIDLNDWKSNTRLKHCVADSNIVRWFWQAVETFDEERRARLLQFVTGSTRVPLQGFKALQGSTGAAGPRLFTIHLIDANTDNLPKAHTCFNRIDIPPYESYEKLYEKLLTAVEETCGFAVE

SEQ ID NO: 63768 - protein, 731 aa, Homo sapiens
MSNPGTRRNGSSIKIRLTVLCAKNLAKKDFFRLPDPFAKIVVDGSGQCHSTDTVKNTLDPKWNQHYDLYVGKTDSITISVWNHKKIHKKQGAGFLGCVRLLSNAISRLKDTGYQRLDLCKLNPSDTDAVRGQIVVSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPRDLNSVNCDELGPLPPGWEVRSTVSGRIYFVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWILENDITPVLDHTFCVEHNAFGRILQHELKPNGRNVPVTEENKKEYVRLYVNWRFMRGIEAQFLALQKGFNELIPQHLLKPFDQKELELIIGGLDKIDLNDWKSNTRLKHCVADSNIVRWFWQAVETFDEERRARLLQFVTGSTRVPLQGFKALQGSTGAAGPRLFTIHLIDANTDNLPKAHTCFNRIDIPPYESYEKLYEKLLTAVEETCGFAVE

SEQ ID NO: 63769 - protein, 440 aa, Homo sapiens
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDQAVEFFIRDKYEKKKYYDKNAIAITNKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGVFMGPTNIPFTSQAPAAFQGFPSMGVPVPAAPGLIGNVMGQSPSMMVGMPMPNGFMGNAQTGVMPLPQNVVGPQGGMVGQMGAPQSKFGLPQAQQPQWSLSQMNQQMAGMSISSATPTAGFGQPSSTTAGWSGSSSGQTLSTQLWK

SEQ ID NO: 63770 - protein, 162 aa, Homo sapiens
MGNTKARLLYEANLPENFRRPQTDQAVEFFIRDKYEKKKYYDKNAIAITNISSSDAPLQPLVSSPSLQAAVDKNKLEKEKEKKKEEKKREKEPEKPAKPLTAEKLQKKDQQLEPKKSTSPKKAAEPTVDLLGLVWRKIEKEKSERQLVEVEELTFMYCFPKN

SEQ ID NO: 63771 - protein, 436 aa, Homo sapiens
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDQAVEFFIRDKYEKKKYYDKNAIAITNKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGVFMGPTNIPFTSQAPAAFQGFPSMGVPVPAAPGLIGNVMGQSPSMMVGMPMPNGFMGNAQTGVMPLPQNVVGPQGGMVGQMGAPQSKFGLPQAQQPQWSLSQIMQKGDAVLQHSISAIYWPMTRWLKCPLVDESADGWHEYQ

SEQ ID NO: 63772 - protein, 467 aa, Homo sapiens
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDQAVEFFIRDKYEKKKYYDKNAIAITNISSSDAPLQPLVSSPSLQAAVDKNKLEKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGVFMGPTNIPFTSQAPAAFQGFPSMGVPVPAAPGLIGNVMGQSPSMMVGMPMPNGFMGNAQTGVMPLPQNVVGPQGGMVGQMGAPQSKFGLPQAQQPQWSLSQMNQQMAGMSISSATPTAGFGQPSSTTAGWSGSSSGQTLSTQLWK

SEQ ID NO: 63773 - protein, 137 aa, Homo sapiens
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDHEDIILETTAVITLLLNKCLPYAKP

SEQ ID NO: 63774 - protein, 125 aa, Homo sapiens
  MOD_RES (1)..(1): Any amino acid
XKYYDKNAIAITNISSSDAPLQPLVSSPSLQAAVDKNKLEKEKEKKKEEKKREKEPEKPAKPLTAEKLQKKDQQLEPKKSTSPKKAAEPTVDLLGLVWRKIEKEKSERQLVEVEELTFMYCFPKN

SEQ ID NO: 63775 - protein, 62 aa, Homo sapiens
MLFLKLSVFRAVEFFIRDKYEKKKYYDKNAIAITNISSSDAPLQPLVSSPSLQAAVDKNKLE

SEQ ID NO: 63776 - protein, 399 aa, Homo sapiens
MIFKGPRWASWNIGVFICIRCAGIHRNLGVHISRVKSVNLDQWTQEQIQCMQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLDAPVACSIANSKTSNTLEKDLDLLASVPSPSSSGSRKVVGSMPTAGSAGSVPENLNLFPEPGSKSEEIGKKQLSKDSILSLYGSQTPQMPTQAMFMAPAQMAYPTAYPSFPGVTPPNSIMGSMMPPPVGMVAQPGASGMVAPMAMPAGYMGGMQASMMGVPNGMMTTQQAGYMAGMAAMPQTVYGVQPAQQLQWNLTQMTQQMAGMNFYGANGMMNYGQSMSGGNGQAANQTLSPQMWK

SEQ ID NO: 63777 - protein, 429 aa, Homo sapiens
MTGKSVKDVDRYQAVLANLLLEEDNKFCADCQSKGPRWASWNIGVFICIRCAGIHRNLGVHISRVKSVNLDQWTQEQIQCMQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLDAPVACSIANSKTSNTLEKDLDLLASVPSPSSSGSRKVVGSMPTAGSAGSVPENLNLFPEPGSKSEEIGKKQLSKDSILSLYGSQTPQMPTQAMFMAPAQMAYPTAYPSFPGVTPPNSIMGSMMPPPVGMVAQPGASGMVAPMAMPAGYMGGMQASMMGVPNGMMTTQQAGYMAGMAAMPQTVYGVQPAQQLQWNLTQMTQQMAGMNFYGANGMMNYGQSMSGGNGQAANQTLSPQMWK

SEQ ID NO: 63778 - protein, 227 aa, Homo sapiens
MTGKSVKDVDRYQAVLANLLLEEDNKFCADCQSKGPRWASWNIGVFICIRCAGIHRNLGVHISRVKSVNLDQWTQEQIQCMQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLDAPVACSIANSKTSNTLEKDLDLLASVPSPSSSGSRK

SEQ ID NO: 63779 - protein, 349 aa, Homo sapiens
MQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLDAPVACSIANSKTSNTLEKDLDLLASVPSPSSSGSRKVVGSMPTAGSAGSVPENLNLFPEPGSKSEEIGKKQLSKDSILSLYGSQTPQMPTQAMFMAPAQMAYPTAYPSFPGVTPPNSIMGSMMPPPVGMVAQPGASGMVAPMAMPAGYMGGMQASMMGVPNGMMTTQQAGYMAGMAAMPQTVYGVQPAQQLQWNLTQMTQQMAGMNFYGANGMMNYGQSMSGGNGQAANQTLSPQMWK

SEQ ID NO: 63780 - protein, 62 aa, Homo sapiens
MARGNQRELARQKNMKKTQEISKGKRKEDSLTASQRKQRDSEIMQEKQKAANEKKSMQTREK

SEQ ID NO: 63781 - protein, 110 aa, Homo sapiens
MARGNQRELARQKNMKKTQEISKGKRKEDSLTASQRKQSSGGQKSESKMSAGPHLPLKAPRENPCFPLPAAGGSRYYLAYGSITPISAFVFVVFFSVFFPSFYEDFCCWI

SEQ ID NO: 63782 - protein, 48 aa, Homo sapiens
MKKTQEISKGKRKEDSLTASQRKQRDSEIMQEKQKAANEKKSMQTREK

SEQ ID NO: 63783 - protein, 20 aa, Homo sapiens
MKKTQEISKGKRKEDSLTAS

SEQ ID NO: 63784 - protein, 96 aa, Homo sapiens
MKKTQEISKGKRKEDSLTASQRKQSSGGQKSESKMSAGPHLPLKAPRENPCFPLPAAGGSRYYLAYGSITPISAFVFVVFFSVFFPSFYEDFCCWI

SEQ ID NO: 63785 - protein, 89 aa, Homo sapiens
MKKTQEISKGKRKEDSLTASQRKQSSGGQKSESKMSAGPHLPLKAPRENPCFPLPAAGGSRYYLAYGSITPISAFVFVVFFSVFFPSFY

SEQ ID NO: 63786 - protein, 1051 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHITINYHHLAASRAASVDDDEEEEDKLHAMLSMICSRNLTAPNPMKDAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 63787 - protein, 1006 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 63788 - protein, 313 aa, Homo sapiens
MDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKLREAPSPTGGVGSFDIAGLLNNPGFMSMASNLMNNPQIQQLMSGMISGGNNPLGTPGTSPSQNDLASLIQAGQQFAQQMQQQNPELIEQLRSQIRSRTPSASNDDQQE

SEQ ID NO: 63789 - protein, 88 aa, Homo sapiens
MNMSKQPVSNVRAIQANINIPMGAFRPGAGQPPRRKECTPEVEEGVPPTSDEEKKPIPGAKKLPGPAVNLSEIQNIKSELKYVPKAEQ

SEQ ID NO: 63790 - protein, 2136 aa, Homo sapiens
MADVTARSLQYEYKANSNLVLQADRSLIDRTRRDEPTGEVLSLVGKLEGTRMGDKAQRTKPQMQEERRAKRRKRDEDRHDINKMKGYTLLSEGIDEMVGIIYKPKTKETRETYEVLLSFIQAALGDQPRDILCGAADEVLAVLKNEKLRDKERRKEIDLLLGQTDDTRYHVLVNLGKKITDYGGDKEIQNMDDNIDETYGVNVQFESDEEEGDEDVYGEVREEASDDDMEGDEAVVRCTLSANLVASGELMSSKKKDLHPRDIDAFWLQRQLSRFYDDAIVSQKKADEVLEILKTASDDRECENQLVLLLGFNTFDFIKVLRQHRMMILYCTLLASAQSEAEKERIMGKMEADPELSKFLYQLHETEKEDLIREERSRRERVRQSRMDTDLETMDLDQGGEALAPRQVLDLEDLVFTQGSHFMANKRCQLPDGSFRRQRKGYEEVHVPALKPKPFGSEEQLLPVEKLPKYAQAGFEGFKTLNRIQSKLYRAALETDENLLLCAPTGAGKTNVALMCMLREIGKHINMDGTINVDDFKIIYIAPMRSLVQEMVGSFGKRLATYGITVAELTGDHQLCKEEISATQIIVCTPEKWDIITRKGGERTYTQLVRLIILDEIHLLHDDRGPVLEALVARAIRNIEMTQEDVRLIGLSATLPNYEDVATFLRVDPAKGLFYFDNSFRPVPLEQTYVGITEKKAIKRFQIMNEIVYEKIMEHAGKNQVLVFVHSRKETGKTARAIRDMCLEKDTLGLFLREGSASTEVLRTEAEQCKNLELKDLLPYGFAIHHAGMTRVDRTLVEDLFADKHIQVLVSTATLAWGVNLPAHTVIIKGTQVYSPEKGRWTELGALDILQMLGRAGRPQYDTKGEGILITSHGELQYYLSLLNQQLPIESQMVSKLPDMLNAEIVLGNVQNAKDAVNWLGYAYLYIRMLRSPTLYGISHDDLKGDPLLDQRRLDLVHTAALMLDKNNLVKYDKKTGNFQVTELGRIASHYYITNDTVQTYNQLLKPTLSEIELFRVFSLSSEFKNITVREEEKLELQKLLERVPIPVKESIEEPSAKINVLLQAFISQLKLEGFALMADMVYVTQSAGRLMRAIFEIVLNRGWAQLTDKTLNLCKMIDKRMWQSMCPLRQFRKLPEEVVKKIEKKNFPFERLYDLNHNEIGELIRMPKMGKTIHKYVHLFPKLELSVHLQPITRSTLKVELTITPDFQWDEKVHGSSEAFWILVEDVDSEVILHHEYFLLKAKYAQDEHLITFFVPVFEPLPPQYFIRVVSDRWLSCETQLPVSFRHLILPEKYPPPTELLDLQPLPVSALRNSAFESLYQDKFPFFNPIQTQVFNTVYNSDDNVFVGAPTGSGKTICAEFAILRMLLQSSEGRCVYITPMEALAEQVYMDWYEKFQDRLNKKVVLLTGETSTDLKLLGKGNIIISTPEKWDILSRRWKQRKNVQNINLFVVDEVHLIGGENGPVLEVICSRMRYISSQIERPIRIVALSSSLSNAKDVAHWLGCSATSTFNFHPNVRPVPLELHIQGFNISHTQTRLLSMAKPVYHAITKHSPKKPVIVFVPSRKQTRLTAIDILTTCAADIQRQRFLHCTEKDLIPYLEKLSDSTLKETLLNGVGYLHEGLSPMERRLVEQLFSSGAIQVVVASRSLCWGMNVAAHLVIIMDTQYYNGKIHAYVDYPIYDVLQMVGHANRPLQDDEGRCVIMCQGSKKDFFKKFLYEPLPVESHLDHCMHDHFNAEIVTKTIENKQDAVDYLTWTFLYRRMTQNPNYYNLQGISHRHLSDHLSELVEQTLSDLEQSKCISIEDEMDVAPLNLGMIAAYYYINYTTIELFSMSLNAKTKVRGLIEIISNAAEYENIPIRHHEDNLLRQLAQKVPHKLNNPKFNDPHVKTNLLLQAHLSRMQLSAELQSDTEEILSKAIRLIQACVDVLSSNGWLSPALAAMELAQMVTQAMWSKDSYLKQLPHFTSEHIKRCTDKGVESVFDIMEMEDEERNALLQLTDSQIADVARFCNRYPNIELSYEVVDKDSIRSGGPVVVLVQLEREEEVTGPVIAPLFPQKREEGWWVVIGDAKSNSLISIKRLTLQQKAKVKLDFVAPATGAHNYTLYFMSDAYMGCDQEYKFSVDVKEAETDSDSD

SEQ ID NO: 63791 - protein, 625 aa, Homo sapiens
MADVTARSLQYEYKANSNLVLQADRSLIDRTRRDEPTGEVLSLVGKLEGTRMGDKAQRTKPQMQEERRAKRRKRDEDRHDINKMKGYTLLSEGIDEMVGIIYKPKTKETRETYEVLLSFIQAALGDQPRDILCGAADEVLAVLKNEKLRDKERRKEIDLLLGQTDDTRYHVLVNLGKKITDYGGDKEIQNMDDNIDETYGVNVQFESDEEEGDEDVYGEVREEASDDDMEGDEAVVRCTLSANLVASGELMSSKKKDLHPRDIDAFWLQRQLSRFYDDAIVSQKKADEVLEILKTASDDRECENQLVLLLGFNTFDFIKVLRQHRMMILYCTLLASAQSEAEKERIMGKMEADPELSKFLYQLHETEKEDLIREERSRRERVRQSRMDTDLETMDLDQGGEALAPRQVLDLEDLVFTQGSHFMANKRCQLPDGSFRRQRKGYEEVHVPALKPKPFGSEEQLLPVEKLPKYAQAGFEGFKTLNRIQSKLYRAALETDENLLLCAPTGAGKTNVALMCMLREIGKHINMDGTINVDDFKIIYIAPMRSLVQEMVGSFGKRDAKSNSLISIKRLTLQQKAKVKLDFVAPATGAHNYTLYFMSDAYMGCDQEYKFSVDVKEAETDSDSD

SEQ ID NO: 63792 - protein, 595 aa, Homo sapiens
MRYISSQIERPIRIVALSSSLSNAKDVAHWLGCSATSTFNFHPNVRPVPLELHIQGFNISHTQTRLLSMAKPVYHAITKHSPKKPVIVFVPSRKQTRLTAIDILTTCAADIQRQRFLHCTEKDLIPYLEKLSDSTLKETLLNGVGYLHEGLSPMERRLVEQLFSSGAIQVVVASRSLCWGMNVAAHLVIIMDTQYYNGKIHAYVDYPIYDVLQMVGHANRPLQDDEGRCVIMCQGSKKDFFKKFLYEPLPVESHLDHCMHDHFNAEIVTKTIENKQDAVDYLTWTFLYRRMTQNPNYYNLQGISHRHLSDHLSELVEQTLSDLEQSKCISIEDEMDVAPLNLGMIAAYYYINYTTIELFSMSLNAKTKVRGLIEIISNAAEYENIPIRHHEDNLLRQLAQKVPHKLNNPKFNDPHVKTNLLLQAHLSRMQLSAELQSDTEEILSKAIRLIQACVDVLSSNGWLSPALAAMELAQMVTQAMWSKDSYLKQLPHFTSEHIKRCTDKGVESVFDIMEMEDEERNALLQLTDSQIADVARFCNRYPNIELSYEVVDKDSIRSGGPVVVLVQLEREEEVTGPVIAPLFPQFRAGRSGSRL

SEQ ID NO: 63793 - protein, 595 aa, Homo sapiens
MAKPVYHAITKHSPKKPVIVFVPSRKQTRLTAIDILTTCAADIQRQRFLHCTEKDLIPYLEKLSDSTLKETLLNGVGYLHEGLSPMERRLVEQLFSSGAIQVVVASRSLCWGMNVAAHLVIIMDTQYYNGKIHAYVDYPIYDVLQMVGHANRPLQDDEGRCVIMCQGSKKDFFKKFLYEPLPVESHLDHCMHDHFNAEIVTKTIENKQDAVDYLTWTFLYRRMTQNPNYYNLQGISHRHLSDHLSELVEQTLSDLEQSKCISIEDEMDVAPLNLGMIAAYYYINYTTIELFSMSLNAKTKVRGLIEIISNAAEYENIPIRHHEDNLLRQLAQKVPHKLNNPKFNDPHVKTNLLLQAHLSRMQLSAELQSDTEEILSKAIRLIQACVDVLSSNGWLSPALAAMELAQMVTQAMWSKDSYLKQLPHFTSEHIKRCTDKGVESVFDIMEMEDEERNALLQLTDSQIADVARFCNRYPNIELSYEVVDKDSIRSGGPVVVLVQLEREEEVTGPVIAPLFPQKREEGWWVVIGDAKSNSLISIKRLTLQQKAKVKLDFVAPATGAHNYTLYFMSDAYMGCDQEYKFSVDVKEAETDSDSD

SEQ ID NO: 63794 - protein, 774 aa, Homo sapiens
MMILYCTLLASAQSEAEKERIMGKMEADPELSKFLYQLHETEKEDLIREERSRRERVRQSRMDTDLETMDLDQGGEALAPRQVLDLEDLVFTQGSHFMANKRCQLPDGSFRRQRKGYEEVHVPALKPKPFGSEEQLLPVEKLPKYAQAGFEGFKTLNRIQSKLYRAALETDENLLLCAPTGAGKTNVALMCMLREIGKHINMDGTINVDDFKIIYIAPMRSLVQEMVGSFGKRLATYGITVAELTGDHQLCKEEISATQIIVCTPEKWDIITRKGGERTYTQLVRLIILDEIHLLHDDRGPVLEALVARAIRNIEMTQEDVRLIGLSATLPNYEDVATFLRVDPAKGLFYFDNSFRPVPLEQTYVGITEKKAIKRFQIMNEIVYEKIMEHAGKNQVLVFVHSRKETGKTARAIRDMCLEKDTLGLFLREGSASTEVLRTEAEQCKNLELKDLLPYGFAIHHAGMTRVDRTLVEDLFADKHIQVLVSTATLAWGVNLPAHTVIIKGTQVYSPEKGRWTELGALDILQMLGRAGRPQYDTKGEGILITSHGELQYYLSLLNQQLPIESQMVSKLPDMLNAEIVLGNVQNAKDAVNWLGYAYLYIRMLRSPTLYGISHDDLKGDPLLDQRRLDLVHTAALMLDKNNLVKYDKKTGNFQVTELGRIASHYYITNDTVQTYNQLLKPTLSEIELFRVFSLSSEFKNITVREEEKLELQKLLERVPIPVKESIEEPSAKINVLLQAFISQLKLEGFALMADMVYVTQSAGRLMRAILKLS

SEQ ID NO: 63795 - protein, 719 aa, Homo sapiens
MLLQSSEGRCVYITPMEALAEQVYMDWYEKFQDRLNKKVVLLTGENGPVLEVICSRMRYISSQIERPIRIVALSSSLSNAKDVAHWLGCSATSTFNFHPNVRPVPLELHIQGFNISHTQTRLLSMAKPVYHAITKHSPKKPVIVFVPSRKQTRLTAIDILTTCAADIQRQRFLHCTEKDLIPYLEKLSDSTLKETLLNGVGYLHEGLSPMERRLVEQLFSSGAIQVVVASRSLCWGMNVAAHLVIIMDTQYYNGKIHAYVDYPIYDVLQMVGHANRPLQDDEGRCVIMCQGSKKDFFKKFLYEPLPVESHLDHCMHDHFNAEIVTKTIENKQDAVDYLTWTFLYRRMTQNPNYYNLQGISHRHLSDHLSELVEQTLSDLEQSKCISIEDEMDVAPLNLGMIAAYYYINYTTIELFSMSLNAKTKVRGLIEIISNAAEYENIPIRHHEDNLLRQLAQKVPHKLNNPKFNDPHVKTNLLLQAHLSRMQLSAELQSDTEEILSKAIRLIQACVDVLSSNGWLSPALAAMELAQMVTQAMWSKDSYLKQLPHFTSEHIKRCTDKGVESVFDIMEMEDEERNALLQLTDSQIADVARFCNRYPNIELSYEVVDKDSIRSGGPVVVLVQLEREEEVTGPVIAPLFPQKREEGWWVVIGDAKSNSLISIKRLTLQQKAKVKLDFVAPATGAHNYTLYFMSDAYMGCDQEYKFSVDVKEAETDSDSD

SEQ ID NO: 63796 - protein, 357 aa, Homo sapiens
MIEQQKRKGPELPLVPVKRQRHELLLGAGSGPGAGQQQATPGALLQAGPPRCSSLQAPIMLLSGHEGEVYCCKFHPNGSTLASAGFDRLILLWNVYGDCDNYATLKGHSGAVMELHYNTDGSMLFSASTDKTVAVWDSETGERVKRLKGHTSFVNSCYPARRGPQLVCTGSDDGTVKLWDIRKKAAIQTFQNTYQVLAVTFNDTSDQIISGGIDNDIKVWDLRQNKLTYTMRGHADSVTGLSLSSEGSYLLSNAMDNTVRVWDVRPFAPKERCVKIFQGNVHNFEKNLLRCSWSPDGSKIAAGSADRFVYVWDTTSRRILYKLPGHAGSINEVAFHPDEPIIISASSDKRLYMGEIQ

SEQ ID NO: 63797 - protein, 127 aa, Homo sapiens
MILISAGCPGGLWPIVVLVGLFIWICFAVRVWDVRPFAPKERCVKIFQGNVHNFEKNLLRCSWSPDGSKIAAGSADRFVYVWDTTSRRILYKLPGHAGSINEVAFHPDEPIIISASSDKRLYMGEIQ

SEQ ID NO: 63798 - protein, 409 aa, Homo sapiens
MIEQQKRKGPELPLVPVKRQRHELLLGAGSGPGAGQQQATPGALLQAGPPRCSSLQAPIMLLSGHEGEVYCCKFHPNGSTLASAGFDRLILLWNVYGDCDNYATLKGHSGAVMELHYNTDGSMLFSASTDKTVAVWDSETGERVKRLKGHTSFVNSCYPARRGPQLVCTGSDDGTVKLWDIRKKAAIQTFQNTYQVLAVTFNDTSDQIISGGIDNDIKVWDLRQNKLTYTMRGHADSVTGLSLSSEGSYLLSNAMDNTVRVWDVRPFAPKERCVKIFQGNVHNFEKNLLRCSWSPDGSKIAAGSADRFVYVWDTTSRRILYKLPGHAGSINEVAFHPDEPIIETGFHRIGQGGHELLTSSNPPASASQSAGITGVSHCAQLQTVFMWVSMSVSPLLISGESKSNAPFSS

SEQ ID NO: 63799 - protein, 282 aa, Homo sapiens
MAVPETRPNHTIYINNLNEKIKKDELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAARDALQGFKITQNNAMKISFAKK

SEQ ID NO: 63800 - protein, 203 aa, Homo sapiens
MAVPETRPNHTIYIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAARDALQGFKITQNNAMKISFAKK

SEQ ID NO: 63801 - protein, 255 aa, Homo sapiens
MVKLTAELIEQAAQYTNAVRDRELDLRGYKIPVIENLGATLDQFDAIDFSDNEIRKLDGFPLLRRLKTLLVNNNRICRIGEGLDQALPCLTELILTNNSLVELGDLDPLASLKSLTYLSILRNPVTNKKHYRLYVIYKVPQVRVLDFQKVKLKERQEAEKMFKGKRGAQLAKDIARRSKTFNPGAGLPTDKKKGGPSPGDVEAIKNAIANASTLAEVERLKGLLQSGQIPGRERRSGPTDDGEEEMEEDTVTNGS

SEQ ID NO: 63802 - protein, 159 aa, Homo sapiens
MPKFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 63803 - protein, 180 aa, Homo sapiens
MNSASVDGHLSGCRLFLFLSPLFRFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 63804 - protein, 118 aa, Homo sapiens
MEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 63805 - protein, 52 aa, Homo sapiens
MRIEGCIIGFDEYMNLVLDDAEEIHSKTKSRKQLGRIMLKGDNITLLQSVSN

SEQ ID NO: 63806 - protein, 92 aa, Homo sapiens
MAYRGQGQKVQKVMVQPINLIFRYLQNRSRIQVWLYEQVNMRIEGCIIGFDEYMNLVLDDAEEIHSKTKSRKQLGRIMLKGDNITLLQSVSN

SEQ ID NO: 63807 - protein, 240 aa, Homo sapiens [sequence omitted]

SEQ ID NO: 63808 - protein, 240 aa, Homo sapiens [sequence omitted]

SEQ ID NO: 63809 - protein, 240 aa, Homo sapiens [sequence omitted]

SEQ ID NO: 63810 - protein, 240 aa, Homo sapiens [sequence omitted]

SEQ ID NO: 63811 - protein, 244 aa, Homo sapiens
MMDSQTVGKSSKMLQHIDYRMRCILQDGRIFIGTFKAFDKHMNLILCDCDEFRKIKPKNAKQPEREEKRVLGLVLLRGENLVSMTVEGPPPKDTGIARVPLAGAAGGPGVGRAAGRGVPAGVPIPQAPAGLAGPVRGVGGPSQQVMTPQGRGTVAAAAVAATASIAGAPTQYPPGRGTPPPPVGRATPPPGIMAPPPGMRPPMGPPIGLPPARGTPIGMPPPGMRPPPPGIRGPPPPGMRPPRP

SEQ ID NO: 63812 - protein, 1086 aa, Homo sapiens
MATVGEWSCVRCTFLNPAGQRQCSICEAPRHKPDLNHILRLSVEEQKWPCARCTFRNFLGKEACEVCGFTPEPAPGAAFLPVLNGVLPKPPAILGEPKGSCQEEAGPVRTAGLVATEPARGQCEDKDEEEKEEQEEEEGAAEPRGGWACPRCTLHNTPVASSCSVCGGPRRLSLPRIPPEALVVPEVVAPAGFHVVPAAPPPGLPGEGAEANPPATSQGPAAEPEPPRVPPFSPFSSTLQNNPVPRSRREVPPQLQPPVPEAAQPSPSAGCRGAPQGSGWAGASRLAELLSGKRLSVLEEEATEGGTSRVEAGSSTSGSDIIDLAGDTVRYTPASPSSPDFTTWSCAKCTLRNPTVAPRCSACGCSKLHGFQEHGEPPTHCPDCGADKPSPCGRSCGRVSSAQKAARVLPERPGQWACPACTLLNALRAKHCAACHTPQLLVAQRRGAAPLRRRESMHVEQRRQTDEGEAKALWENIVAFCRENNVSFVDDSFPPGPESVGFPAGDSVQQRVRQWLRPQEINCSVFRDHRATWSVFHTLRPSDILQGLLGNCWFLSALAVLAERPDLVERVMVTRSLCAEGAYQVRLCKDGTWTTVLVDDMLPCDEAGCLLFSQAQRKQLWVALIEKALAKLHGSYFALQAGRAIEGLATLTGAPCESLALQLSSTNPREEPVDTDLIWAKMLSSKEAGFLMGASCGGGNMKVDDSAYESLGLRPRHAYSILDVRDVQGTRLLRLRNPWGRFSWNGSWSDEWPHWPGHLRGELMPHGSSEGVFWMEYGDFVRYFDSVDICKVHSDWQEARVQGCFPSSASAPVGVTALTVLERASLEFALFQEGSRRSDAVDSHLLDLCILVFRATFGSGGHLSLGRLLAHSKRAVKKFVSCDVMLEPGEYAVVCCAFNHWGPPLPGTPAPQASSPSAGVPRASPEPPGHVLAVYSSRLVMVEPVEAQPTTLADAIILLTESRGERHEGREGMTCYYLTHGWAGLIVVVENRHPKAYLHVQCDCTDSFNVVSTRGSLRTQDSVPPLHRQVLVILSQLEGNAGFSITHRLAHRKAAQAFLSDWTASKGTHSPPLTPEVAGLHGPRPL

SEQ ID NO: 63813 - protein, 415 aa, Homo sapiens
MATVGEWSCVRCTFLNPAGQRQCSICEAPRHKPDLNHILRLSVEEQKWPCARCTFRNFLGKEACEVCGFTPEPAPGAAFLPVLNGVLPKPPAILGEPKGSCQEEAGPVRTAGLVATEPARGQCEDKDEEEKEEQEEEEGAAEPRGGWACPRCTLHNTPVASSCSVCGGPRRLSLPRIPPEALVVPEVVAPAGFHVVPAAPPPGLPGEGAEANPPATSQGPAAEPEPPRVPPFSPFSSTLQNNPVPRSRREVPPQLQPPVPEAAQPSPSAGCRGAPQGSGWAGASRLAELLSGKRLSVLEEEATEGGTSRVEAGSSTSGSDIIDLAGDTVRYTPASPSSPDFTTWSCAKCTLRNPSPPSLQPLGRGPESLPRAAGPRAGCVQLEAGHGGARGSPADHAGRRHHPAHREPRRAARGP

SEQ ID NO: 63814 - protein, 89 aa, Homo sapiens
MSSQQQKQPCTPPPQLQQQQVKQPCQPPPQEPCIPKTKEPCHPKVPEPCHPKVPEPCQPKVPEPCHPKVPEPCPSIVTPAPAQQKTKQK

SEQ ID NO: 63815 - protein, 73 aa, Homo sapiens
MSSQQQKQPCTPPPQLQQQQVKQPCQPPPQEPCIPKTKEPCHPKVPEPCHPKVPEPCPSIVTPAPAQQKTKQK

SEQ ID NO: 63816 - protein, 72 aa, Homo sapiens
MSYQQQQCKQPCQPPPVCPTPKCPEPCPPPKCPEPCPPPKCPQPCPPQQCQQKYPPVTPSPPCQSKYPPKSK

SEQ ID NO: 63817 - protein, 72 aa, Homo sapiens
MSYQQQQCKQPCQPPPVCPTPKCPEPCPPPKCPEPCPPPKCPQPCPPQQCQQKYPPVTPSPPCQPKYPPKSK

SEQ ID NO: 63818 - protein, 72 aa, Homo sapiens; identical to SEQ ID NO: 63817

SEQ ID NO: 63819 - protein, 72 aa, Homo sapiens; identical to SEQ ID NO: 63817

SEQ ID NO: 63820 - protein, 169 aa, Homo sapiens
MSSYQQKQTFTPPPQLQQQQVKQPSQPPPQEIFVPTTKEPCHSKVPQPGNTKIPEPGCTKVPEPGCTKVPEPGCTKVPEPGCTKVPEPGCTKVPEPGCTKVPEPGYTKVPEPGSIKVPDQGFIKFPEPGAIKVPEQGYTKVPVPGYTKLPEPCPSTVTPGPAQQKTKQK

SEQ ID NO: 63821 - protein, 169 aa, Homo sapiens; identical to SEQ ID NO: 63820

SEQ ID NO: 63822 - protein, 159 aa, Homo sapiens [sequence omitted]

SEQ ID NO: 63823 - protein, 161 aa, Homo sapiens
MSSYQQKQTFTPPPQLQQQQVKQPSQPPPQEIFVPTTKEPCHSKVPQPGNTKIPEPGCTKVPEPGCTKVPEPGCTKVPEPGCTKVPEPGCTKVPEPGYTKVPEPGSIKVPDQGFIKFPEPGAIKVPEQGYTKVPVPGYTKLPEPCPSTVTPGPAQQKTKQK

SEQ ID NO: 63824 - protein, 3662 aa, Homo sapiens
MSRRAPGSRLSSGGGGGGTKYPRSWNDWQPRTDSASADPDNLKYSSSRDRGGSSSYGLQPSNSAVVSRQRHDDTRVHADIQNDEKGGYSVNGGSGENTYGRKSLGQELRVNNVTSPEFTSVQHGSRALATKDMRKSQERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLLGQFLEDMEAYAEDLSHVASGESVDEDVPPPSVSLPKLAALLRVFSTVVRSIGERFSPIRGPPITEAYVTDVLYRVMRCVTAANQVFFSEAVLTAANECVGVLLGSLDPSMTIHCDMVITYGLDQLENCQTCGTDYIISVLNLLTLIVEQINTKLPSSFVEKLFIPSSKLLFLRYHKEKEVVAVAHAVYQAVLSLKNIPVLETAYKLILGEMTCALNNLLHSLQLPEACSEIKHEAFKNHVFNVDNAKFVVIFDLSALTTIGNAKNSLIGMWALSPTVFALLSKNLMIVHSDLAVHFPAIQYAVLYTLYSHCTRHDHFISSSLSSSSPSLFDGAVISTVTTATKKHFSIILNLLGILLKKDNLNQDTRKLLMTWALEAAVLMKKSETYAPLFSLPSFHKFCKGLLANTLVEDVNICLQACSSLHALSSSLPDDLLQRCVDVCRVQLVHSGTRIRQAFGKLLKSIPLDVVLSNNNHTEIQEISLALRSHMSKAPSNTFHPQDFSDVISFILYGNSHRTGKDNWLERLFYSCQRLDKRDQSTIPRNLLKTDAVLWQWAIWEAAQFTVLSKLRTPLGRAQDTFQTIEGIIRSLAAHTLNPDQDVSQWTTADNDEGHGNNQLRLVLLLQYLENLEKLMYNAYEGCANALTSPPKVIRTFFYTNRQTCQDWLTRIRLSIMRVGLLAGQPAVTVRHGFDLLTEMKTTSLSQGNELEVTIMMVVEALCELHCPEAIQGIAVWSSSIVGKNLLWINSVAQQAEGRFEKASVEYQEHLCAMTGVDCCISSFDKSVLTLANAGRNSASPKHSLNGESRKTVLSKPTDSSPEVINYLGNKACECYISIADWAAVQEWQNAIHDLKKSTSSTSLNLKADFNYIKSLSSFESGKFVECTEQLELLPGENINLLAGGSKEKIDMKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVNWFKNRDEMLVVLPKLDGSLDEYLSLQEQLTDVEKLQGKLLEEIEFLEGAEGVDHPSHTLQHRYSEHTQLQTQQRAVQEAIQVKLNEFEQWITHYQAAFNNLEATQLASLLQEISTQMDLGPPSYVPATAFLQNAGQAHLISQCEQLEGEVGALLQQRRSVLRGCLEQLHHYATVALQYPKAIFQKHRIEQWKTWMEELICNTTVERCQELYRKYEMQYAPQPPPTVCQFITATEMTLQRYAADINSRLIRQVERLKQEAVTVPVCEDQLKEIERCIKVFLHENGEEGSLSLASVIISALCTLTRRNLMMEGAASSAGEQLVDLTSRDGAWFLEELCSMSGNVTCLVQLLKQCHLVPQDLDIPNPMEASETVHLANGVYTSLQELNSNFRQIIFPEALRCLMKGEYTLESMLHELDGLIEQTTDGVPLQTLVESLQAYLRNAAMGLEEETHAHYIDVARLLHAQYGELIQPRNGSVDETPKMSAGQMLLVAFDGMFAQVETAFSLLVEKLNKMEIPIAWRKIDIIREARSTQVNFFDDDNHRQVLEEIFFLKRLQTIKEFFRLCGTFSKTLSGSSSLEDQNTVNGPVQIVNVKTLFRNSCFSEDQMAKPIKAFTADFVRQLLIGLPNQALGLTLCSFISALGVDIIAQVEAKDFGAESKVSVDDLCKKAVEHNIQIGKFSQLVMNRATVLASSYDTAWKKHDLVRRLETSISSCKTSLQRVQLHIAMFQQWQHEDLLINRPQAMSVTPPPRSAILTSMKKKLHTLSQIETSIATVQEKLAALESSIEQRLKWAGGANPALAPVLQDFEATIAERRNLVLKESQRASQVTFLCSNIIHFESLRTRTAEALNLDAALFELIKRCQQMCSFASQFNSSVSELELRLLQRVDTGLEHPIGSSEWLLSAHKQLTQDMSTQRAIQTEKEQQIETVCETIQNLVDNIKTVLTGHNRQLGDVKHLLKAMAKDEEAALADGEDVPYENSVRQFLGEYKSWQDNIQTVLFTLVQAMGQVRSQEHVEMLQEITPTLKELKTQSQSIYNNLVSFASPLVTDATNECSSPTSSATYQPSFAAAVRSNTGQKTQPDVMSQNARKLIQKNLATSADTPPSTVPGTGKSVACSPKKAVRDPKTGKAVQERNSYAVSVWKRVKAKLEGRDVDPNRRMSVAEQVDYVIKEATNLDNLAQLYEGWTAWV

SEQ ID NO: 63825 - protein, 3661 aa, Homo sapiens
MSRRAPGSRLSSGGGGGGTKYPRSWNDWQPRTDSASADPDNLKYSSSRDRGGSSSYGLQPSNSAVVSRQRHDDTRVHADIQNDEKGGYSVNGGSGENTYGRKSLGQELRVNNVTSPEFTSVQHGSRALATKDMRKSQERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLLGQFLEDMEAYAEDLSHVASGESVDEDVPPPSVSLPKLAALLRVFSTVVRSIGERFSPIRGPPITEAYVTDVLYRVMRCVTAANQVFFSEAVLTAANECVGVLLGSLDPSMTIHCDMVITYGLDQLENCQTCGTDYIISVLNLLTLIVEQINTKLPSSFVEKLFIPSSKLLFLRYHKEKEVVAVAHAVYQAVLSLKNIPVLETAYKLILGEMTCALNNLLHSLQLPEACSEIKHEAFKNHVFNVDNAKFVVIFDLSALTTIGNAKNSLIGMWALSPTVFALLSKNLMIVHSDLAVHFPAIQYAVLYTLYSHCTRHDHFISSSLSSSSPSLFDGAVISTVTTATKKHFSIILNLLGILLKKDNLNQDTRKLLMTWALEAAVLMKKSETYAPLFSLPSFHKFCKGLLANTLVEDVNICLQACSSLHALSSSLPDDLLQRCVDVCRVQLVHSGTRIRQAFGKLLKSIPLDVVLSNNNHTEIQEISLALRSHMSKAPSNTFHPQDFSDVISFILYGNSHRTGKDNWLERLFYSCQRLDKRDQSTIPRNLLKTDAVLWQWAIWEAAQFTVLSKLRTPLGRAQDTFQTIEGIIRSLAAHTLNPDQDVSQWTTADNDEGHGNNQLRLVLLLQYLENLEKLMYNAYEGCANALTSPPKVIRTFFYTNRQTCQDWLTRIRLSIMRVGLLAGQPAVTVRHGFDLLTEMKTTSLSQGNELEVTIMMVVEALCELHCPEAIQGIAVWSSSIVGKNLLWINSVAQQAEGRFEKASVEYQEHLCAMTGVDCCISSFDKSVLTLANAGRNSASPKHSLNGESRKTVLSKPTDSSPEVINYLGNKACECYISIADWAAVQEWQNAIHDLKKSTSSTSLNLKADFNYIKSLSSFESGKFVECTEQLELLPGENINLLAGGSKEKIDMKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVNWFKNRDEMLVVLPKLDGSLDEYLSLQEQLTDVEKLQGKLLEEIEFLEGAEGVDHPSHTLQHRYSEHTQLQTQQRAVQEAIQVKLNEFEQWITHYQAAFNNLEATQLASLLQEISTQMDLGPPSYVPATAFLQNAGQAHLISQCEQLEGEVGALLQQRRSVLRGCLEQLHHYATVALQYPKAIFQKHRIEQWKTWMEELICNTTVERCQELYRKYEMQYAPQPPPTVCQFITATEMTLQRYAADINSRLIRQVERLKQEAVTVPVCEDQLKEIERCIKVFLHENGEEGSLSLASVIISALCTLTRRNLMMEGAASSAGEQLVDLTSRDGAWFLEELCSMSGNVTCLVQLLKQCHLVPQDLDIPNPMEASETVHLANGVYTSLQELNSNFRQIIFPEALRCLMKGEYTLESMLHELDGLIEQTTDGVPLQTLVESLQAYLRNAAMGLEEETHAHYIDVARLLHAQYGELIQPRNGSVDETPKMSAGQMLLVAFDGMFAQVETAFSLLVEKLNKMEIPIAWRKIDIIREARSTQVNFFDDDNHRQVLEEIFFLKRLQTIKEFFRLCGTFSKTLSGSSSLEDQNTVNGPVQIVNVKTLFRNSCFSEDQMAKPIKAFTADFVRQLLIGLPNQALGLTLCSFISALGVDIIAQVEAKDFGAESKVSVDDLCKKAVEHNIQIGKFSQLVMNRATVLASSYDTAWKKHDLVRRLETSISSCKTSLQRVQLHIAMFQWQHEDLLINRPQAMSVTPPPRSAILTSMKKKLHTLSQIETSIATVQEKLAALESSIEQRLKWAGGANPALAPVLQDFEATIAERRNLVLKESQRASQVTFLCSNIIHFESLRTRTAEALNLDAALFELIKRCQQMCSFASQFNSSVSELELRLLQRVDTGLEHPIGSSEWLLSAHKQLTQDMSTQRAIQTEKEQQIETVCETIQNLVDNIKTVLTGHNRQLGDVKHLLKAMAKDEEAALADGEDVPYENSVRQFLGEYKSWQDNIQTVLFTLVQAMGQVRSQEHVEMLQEITPTLKELKTQSQSIYNNLVSFASPLVTDATNECSSPTSSATYQPSFAAAVRSNTGQKTQPDVMSQNARKLIQKNLATSADTPPSTVPGTGKSVACSPKKAVRDPKTGKAVQERNSYAVSVWKRVKAKLEGRDVDPNRRMSVAEQVDYVIKEATNLDNLAQLYEGWTAWV

SEQ ID NO: 63826 - protein, 1016 aa, Homo sapiens
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 63827 - protein, 374 aa, Homo sapiens
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSRGCTSHCPTSALCLPLSSFQGREQAPPRAAGSLACASTVSCAHQPHRCCALCSWLLCWDRMGCQEEKKGGAV

SEQ ID NO: 63828 - protein, 138 aa, Homo sapiens
  MOD_RES (1)..(1): Any amino acid
XFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 63829 - protein, 1145 aa, Homo sapiens
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVRRDYSKGITVTKNDGKKDNNKRKTETKKCTLEKLQETGKQNVAVQVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEDPKSSPLLPPDLLKSLAALEEEEELIFSNPPDLYPALLGPLASLPGRSLFKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 63830 - protein, 1137 aa, Homo sapiens
MSLQSAQYLRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVRRDYSKGITVTKNDGKKDNNKRKTETKKCTLEKLQETGKQNVAVQVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 63831 - protein, 1170 aa, Homo sapiens
MRNWMFLQIVIVGENVSFKSQMRTENLKSEEHLKSSNIRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEDPKSSPLLPPDLLKSLAALEEEEELIFSNPPDLYPALLGPLASLPGRSLFKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 63832 - protein, 757 aa, Homo sapiens
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPL

SEQ ID NO: 63833 - protein, 1049 aa, Homo sapiens
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 63834 - protein, 1178 aa, Homo sapiens
MSLQSAQYLRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEDPKSSPLLPPDLLKSLAALEEEEELIFSNPPDLYPALLGPLASLPGRSLFKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKKQQHGVQQLGPKRQSEEEGSSSICVAHRGPRPLPSCSLPASTFRVKFKAARTCAHQAQKKTRRRPFWKRRKKGK

SEQ ID NO: 63835 - protein, 1091 aa, Homo sapiens
MSLQSAQYLRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 63836 - protein, 991 aa, Homo sapiens
MAGPVSLRDLLMGASAWMGSESPGGSPTEGGGSAAGGPEPPWREDEICVVGIFGKTALRLNSEKFSLVNTVCDRQVFPLFRHQDPGDPGPGIRTEAGAVGEAGGAEDPGAAAGGSVRGSGAVAEGNRTEAGSQDYSLLQAYYSQESKVLYLLLTSICDNSQLLRACRALQSGEAGGGLSLPHAEAHEFWKHQEKLQCLSLLYLFSVCHILLLVHPTCSFDITYDRVFRALDGLRQKVLPLLKTAIKDCPVGKDWKLNCRPCPPRLLFLFQLNGALKVEPPRNQDPAHPDKPKKHSPKRRLQHALEDQIYRIFRKSRVLTNQSINCLFTVPANQAFVYIVPGSQEEDPVGMLLDQLRSHCTVKDPESLLVPAPLSGPRRYQVMRQHSRQQLSFHIDSSSSSSSGQLVDFTLREFLWQHVELVLSKKGFDDSVGRNPQPSHFELPTYQKWISAASKLYEVAIDGKEEDLGSPTGELTSKILSSIKVLEGFLDIDTKFSENRCQKALPMAHSAYQSNLPHNYTMTVHKNQLAQALRVYSQHARGPAFHKYAMQLHEDCYKFWSNGHQLCEERSLTDQHCVHKFHSLPKSGEKPEADRNPPVLYHNSRARSTGACNCGRKQAPRDDPFDIKAANYDFYQLLEEKCCGKLDHINFPVFEPSTPDPAPAKNESSPAPPDSDADKLKEKEPQTQGESTSLSLALSLGQSTDSLGTYPADPQAGGDNPEVHGQVEVKTEKRPNFVDRQASTVEYLPGMLHSNCPKGLLPKFSSWSLVKLGPAKSYNFHTGLDQQGFIPGTNYLMPWDIVIRTRAEDEGDLDTNSWPAPNKAIPGKRSAVVMGRGRRRDDIARAFVGFEYEDSRGRRFMCSGPDKVMKVMGSGPKESALKALNSDMPLYILSSSQGRGLKPHYAQLMRLFVVVPDAPLQIILMPQVQPGPPPCPVFYPEKQEITLPPDGLWVLRFPYAYVTERGPCFPPKENVQLMSYKVLRGVLKAVTQ

SEQ ID NO: 63837 - protein, 974 aa, Homo sapiens
MAGPVSLRDLLMGASAWMGSESPGGSPTEGGGSAAGGPEPPWREDEICVVGIFGKTALRLNSEKFSLVNTVCDRQVFPLFRHQDPGDPGPGIRTEAGAVGEAGGAEDPGAAAGGSVRGSGAVAEGNRTEAGSQDYSLLQAYYSQESKVLYLLLTSICDNSQLLRACRALQSGEAGGGLSLPHAEAHEFWKHQEKLQCLSLLYLFSVCHILLLVHPTCSFDITYDRVFRALDGLRQKVLPLLKTAIKDCPVGKDWKLNCRPCPPRLLFLFQLNGALKVEPPRNQDPAHPDKPKKHSPKRRLQHALEDQIYRIFRKSRVLTNQSINCLFTVPANQAFVYIVPGSQEEDPVGMLLDQLRSHCTVKDPESLLVPAPLSGPRRYQVMRQHSRQQLSFHIDSSSSSSSGQLVDFTLREFLWQHVELVLSKKGFDDSVGRNPQPSHFELPTYQKWISAASKLYEVAIDGKEEDLGSPTGELTSKILSSIKVLEGFLDIDTKFSENRCQKALPMAHSAYQSNLPHNYTMTVHKNQLAQALRVYSQHARGPAFHKYAMQLHEDCYKFWSNGHQLCEERSLTDQHCVHKFHSLPKSGEKPEADRNPPVLYHNSRARSTGACNCGRKQAPRDDPFDIKAANYDFYQLLEEKCCGKLDHINFPVFEPSTPDPAPAKNESSPAPPDSDADKLKEKEPQTQGESTSLSLALSLGQSTDSLGTYPADPQAGGDNPEVHGQVEVKTEKRPNFVDRQASTVEYLPGMLHSNCPKGLLPKFSSWSLVKLGPAKSYNFHTGLDQQGFIPGTNYLMPWDIVIRTRAEDEGDLDTNSWPAPNKAIPGKRSAVVMGRGRRRDDIARAFVGFEYEDSRGRRFMCSGPDKVMKVMGSGPKESALKALNSDMPLYILSSSQGRGLKPHYAQLMRLFVVVPDAPLQIILMPQVQPGPPPCPVFYPEKQEITLPPDGLWVLRFPYAYLREDLVSPLRKMCS

SEQ ID NO: 63838 - protein, 520 aa, Homo sapiens
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTGASTPEGTAPPPPAAPAPPKGEKEGQRPTQPVYQIQNRGMGTAAPAAMDPVVGQAKLLPPERMKHSIKLVDDQMNWCDSAIEYLLDQTDVLVVGVLGLQGTGKSMVMSLLSANTPEEDQRTYVFRAQSAEMKERGGNQTSGIDFFITQERIVFLDTQPILSPSILDHLINNDRKLPPEYNLPHTYVEMQSLQIAAFLFTVCHVVIVVQDWFTDLSLYRFLQTAEMVKPSTPSPSHESSSSSGSDEGTEYYPHLVFLQNKARREDFCPRKLRQMHLMIDQLMAHSHLRYKGTLSMLQCNVFPGLPPDFLDSEVNLFLVPFMDSEAESENPPRAGPGSSPLFSLLPGYRGHPSFQSLVSKLRSQVMSMARPQLSHTILTEKNWFHYAARIWDGVRKSSALAEYSRLLA

SEQ ID NO: 63839 - protein, 913 aa, Homo sapiens
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLPRKAPGPLPHQHHPCLLLQRLLLSGPDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEAEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 63840 - protein, 915 aa, Homo sapiens
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEAEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 63841 - protein, 917 aa, Homo sapiens
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEAEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAEMLVDCVPLVEVDDMMIMGKKPDPKCVFTYVQSLYNHLRRHELRLRGKNV

SEQ ID NO: 63842 - protein, 295 aa, Homo sapiens
MEAEPAEPLAAAVEAANGAEQTRVNKAPEGRSPLSAEELMTIEDEGVLDKMLDQSTDFEERKLIRAALRELRQRKRDGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 63843 - protein, 938 aa, Homo sapiens
MTCLSHPLQLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKAAEDAGTPVAHPPAFSTRRRSSTGTTRSTSLMEAEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 63844 - protein, 37 aa, Homo sapiens
MADEALAGLDEGALRKLLEVTADLAERRRIRSAIREL

SEQ ID NO: 63845 - protein, 940 aa, Homo sapiens
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEAEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKMLVDCVPLVEVDDMMIMGKKPDPKCVFTYVQSLYNHLRRHELRLRGKNV

SEQ ID NO: 63846 - protein, 457 aa, Homo sapiens
MEQKEGKLSEDGTTVSPAADNPEMSGGGAPAEETKGTAGKAINEGPPTESGKQEKAPAEDGMSAELQGEANGLDEVKVESQREAGGKEDAEAELKKEDGEKEETTVGSQEMTGRKEETKSEPKEAEEKESTLASEKQKAEEKEAKPESGQKADANDRDKPEPKATVEEEDAKTASQEETVVEDEAKAEPKEPDGKEEAKHGAKEEADEPGSPSEEQEQDVEKEPEGGAGVIPSSPEEWPESPTGEGHNLSTDGLGPDCVASGQTSPSASESSPSDVPQSPPESPSSGEKKEKAPERRVSAPARPRGPRAQNRKAIVDKFGGAASGPTALFRNTKAAGAAIGGVKNMLLEWCRAMTKKYEHVDIQNFSSSWSSGMAFCALIHKFFPDAFDYAELDPAKRRHNFTLAFSTAEKLADCAQLLDVDDMVRLAVPDSKCVYTYIQELYRSLVQKGLVKTKKK

SEQ ID NO: 63847 - protein, 512 aa, Homo sapiens
MLPGAVGESDCSAEAREKMEQKEGKLSEDGTTVSPAADNPEMSGGGAPAEETKGTAGKAINEGPPTESGKQEKAPAEDGMSAELQGEANGLDEVKVESQREAGGKEDAEAELKKEDGEKEETTVGSQEMTGRKEETKSEPKEAEEKESTLASEKQKAEEKEAKPESGQKADANDRDKPEPKATVEEEDAKTASQEETGQRKECSTEPKEKATDEEAKAESQKAVVEDEAKAEPKEPDGKEEAKHGAKEEADAKEEAEDAEEAEPGSPSEEQEQDVEKEPEGGAGVIPSSPEEWPESPTGEGHNLSTDGLGPDCVASGQTSPSASESSPSDVPQSPPESPSSGEKKEKAPERRVSAPARPRGPRAQNRKAIVDKFGGAASGPTALFRNTKAAGAAIGGVKNMLLEWCRAMTKKYEHVDIQNFSSSWSSGMAFCALIHKFFPDAFDYAELDPAKRRHNFTLAFSTAEKLADCAQLLDVDDMVRLAVPDSKCVYTYIQELYRSLVQKGLVKTKKK

SEQ ID NO: 63848 - protein, 494 aa, Homo sapiens
MEQKEGKLSEDGTTVSPAADNPEMSGGGAPAEETKGTAGKAINEGPPTESGKQEKAPAEDGMSAELQGEANGLDEVKVESQREAGGKEDAEAELKKEDGEKEETTVGSQEMTGRKEETKSEPKEAEEKESTLASEKQKAEEKEAKPESGQKADANDRDKPEPKATVEEEDAKTASQEETGQRKECSTEPKEKATDEEAKAESQKAVVEDEAKAEPKEPDGKEEAKHGAKEEADAKEEAEDAEEAEPGSPSEEQEQDVEKEPEGGAGVIPSSPEEWPESPTGEGHNLSTDGLGPDCVASGQTSPSASESSPSDVPQSPPESPSSGEKKEKAPERRVSAPARPRGPRAQNRKAIVDKFGGAASGPTALFRNTKAAGAAIGGVKNMLLEWCRAMTKKYEHVDIQNFSSSWSSGMAFCALIHKFFPDAFDYAELDPAKRRHNFTLAFSTAEKLADCAQLLDVDDMVRLAVPDSKCVYTYIQELYRSLVQKGLVKTKKK

SEQ ID NO: 63849 - protein, 103 aa, Homo sapiens
MSEEKPKEGVKTENDHINLKVAGQDGSVVQFKIKRHTPLSKLMKAYCERQGLSMRQIRFRFDGQPINETDTPAQLEMEDEDTIDVFQQQTGGVPESSLAGHSF

SEQ ID NO: 63850 - protein, 141 aa, Homo sapiens
MSEEKPKEGVKTENDHINLKVAGQDGSVVQFKIKRHTPLSKLMKAYCERQVRHLAPPQSLPVCALVLCVPGIPRARASRGWTQMQLPEGLSMRQIRFRFDGQPINETDTPAQLEMEDEDTIDVFQQQTGGVPESSLAGHSF

SEQ ID NO: 63851 - protein, 95 aa, Homo sapiens
MANEKPTEEVKTENNNHINLKVAGQDGSVVQFKIKRQTPLSKLMKAYCEPRGLSVKQIRFRFGGQPISGTDKPAQLEMEDEDTIDVFQQPTGGVY

SEQ ID NO: 63852 - protein, 136 aa, Homo sapiens
MAGAGSAAVSGAGTPVAGPTGRDLFAEGLLEFLRPAVQQLDSHVHAVRESQVELREQIDNLATELCRINEDQKVALDLDPYVKKLLNARRRVVLVNNILQNAQERLRRLNHSVAKETARRRAMLDSGIYPPGSPGK

SEQ ID NO: 63853 - protein, 765 aa, Homo sapiens
MAGFKRGYDGKIAGLYDLDKTLGRGHFAVVKLARHVFTGEKVAVKVIDKTKLDTLATGHLFQEVRCMKLVQHPNIVRLYEVIDTQTKLYLILELGDGGDMFDYIMKHEEGLNEDLAKKYFAQIVHAISYCHKLHVVHRDLKPENVVFFEKQGLVKLTDFGFSNKFQPGKKLTTSCGSLAYSAPEILLGDEYDAPAVDIWSLGVILFMLVCGQPPFQEANDSETLTMIMDCKYTVPSHVSKECKDLITRMLQRDPKRRASLEEIENHPWLQGVDPSPATKYNIPLVSYKNLSEEEHNSIIQRMVLGDIADRDAIVEALETNRYNHITATYFLLAERILREKQEKEIQTRSASPSNIKAQFRQSWPTKIDVPQDLEDDLTATPLSHATVPQSPARAADSVLNGHRSKGLCDSAKKDDLPELAGPALSTVPPASLKPTASGRKCLFRVEEDEEEDEEDKKPMSLSTQVVLRRKPSVTNRLTSRKSAPVLNQIFEEGESDDEFDMDENLPPKLSRLKMNIASPGTVHKRYHRRKSQGRGSSCSSSETSDDDSESRRRLDKDSGFTYSWHRRDSSEGPPGSEGDGGGQSKPSNASGGVDKASPSENNAGGGSPSSGSGGNPTNTSGTTRRCAGPSNSMQLASRSAGELVESLKLMSLCLGSQLHGSTKYIIDPQNGLSFSSVKVQEKSTWKMCISSTGNAGQVPAVGGIKFFSDHMADTTTELERIKSKNLKNNVLQLPLCEKTISVNIQRNPKEGLLCASSPASCCHVI

SEQ ID NO: 63854 - protein, 765 aa, Homo sapiens; identical to SEQ ID NO: 63853

SEQ ID NO: 63855 - protein, 765 aa, Homo sapiens; identical to SEQ ID NO: 63853

SEQ ID NO: 63856 - protein, 3230 aa, Homo sapiens
MQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQRNVVHLVSAGGQHHLISQPAHVALIQAVAPTPGPTPVSVLPSSTPSTTPAPTGLSLPLAANQVPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSVTPPLAPVVPAAPGPPSLAPSGASPSASALTLGLATAPSLSSSQTPGHPLLLAPTSSHVPGLNSTVAPACSPVLVPASALASPFPSAPNPAPAQASLLAPASSASQALATPLAPMAAPQTAILAPSPAPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 63857 - protein, 3072 aa, Homo sapiens
MQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQAGEVVSIGQLASLAQRPVANAGGSKPLTFQIQGNKLTLTGAQVRQLAVGQPRPLQMPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSVTPPLAPVVPAAPGPPSLAPSGASPSASALTLGLATAPSLSSSQTPGHPLLLAPTSSHVPGLNSTVAPACSPVLVPASALASPFPSAPNPAPAQASLLAPASSASQALATPLAPMAAPQTAILAPSPAPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 63858 - protein, 3168 aa, Homo sapiens
MQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQMPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSVTPPLAPVVPAAPGPPSLAPSGASPSASALTLGLATAPSLSSSQTPGHPLLLAPTSSHVPGLNSTVAPACSPVLVPASALASPFPSAPNPAPAQASLLAPASSASQALATPLAPMAAPQTAILAPSPAPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 63859 - protein, 59 aa, Homo sapiens
MQSSPSPAHPQLPVLQTQMVSDGMTGSNPVSPASSSSPASSGAGGISPQHIAQDSSLDG

SEQ ID NO: 63860 - protein, 257 aa, Homo sapiens
MHRRGVGAGAIAKKKLAEAKYKERGTVLAEDQLAQMSKQLDMFKTNLEEFASKHKQEIRKNPEFRVQFQDMCATIGVDPLASGKGFWSEMLGVGDFYYELGVQIIEVCLALKHRNGGLITLEELHQQVLKGRGKFAQDVSQDDLIRAIKKLKALGTGFGIIPVGGTYLIQSVPAELNMDHTVVLQLAENGYVTVSEIKASLKWETERARQVLEHLLKEGLAWLDLQAPGEAHYWLPALFTDLYSQEITAEEAREALP

SEQ ID NO: 63861 - protein, 258 aa, Homo sapiens
MHRRGVGAGAIAKKKLAEAKYKERGTVLAEDQLAQMSKQLDMFKTNLEEFASKHKQEIRKNPEFRVQFQDMCATIGVDPLASGKGFWSEMLGVGDFYYELGVQIIEVCLALKHRNGGLITLEELHQQVLKGRGKFAQDVSQDDLIRAIKKLKALGTGFGIIPVGGTYLIQSVPAELNMDHTVVLQLAEKNGYVTVSEIKASLKWETERARQVLEHLLKEGLAWLDLQAPGEAHYWLPALFTDLYSQEITAEEAREALP

SEQ ID NO: 63862 - protein, 536 aa, Homo sapiens
MSSSLGKEKDSKEKDPKVPSAKEREKEAKASGGFGKESKEKEPKTKGKDAKDGKKDSSAAQPGVAFSVDNTIKRPNPAPGTRKKSSNAEVIKELNKCREENSMRLDLSKRSIHILPSSIKELTQLTELYLYSNKLQSLPAEVGCLVNLMTLALSENSLTSLPDSLDNLKKLRMLDLRHNKLREIPSVVYRLDSLTTLYLRFNRITTVEKDIKNLSKLSMLSIRENKIKQLPAEIGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 63863 - protein, 582 aa, Homo sapiens
MSSSLGKEKDSKEKDPKVPSAKEREKEAKASGGFGKESKEKEPKTKGKDAKDGKKDSSAAQPGVAFSVDNTIKRPNPAPGTRKKSSNAEVIKELNKCREENSMRLDLSKRSIHILPSSIKELTQLTELYLYSNKLQSLPAEVGCLVNLMTLALSENSLTSLPDSLDNLKKLRMLDLRHNKLREIPSVVYRLDSLTTLYLRFNRITTVEKDIKNLSKLSMLSIRENKIKQLPAEIGELCNLITLDVAHNQLEHLPKEIGNCTQITNLDLQHNELLDLPDTIGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 63864 - protein, 372 aa, Homo sapiens
LDNLKKLRMLDLRHNKLREIPSVVYRLDSLTTLYLRFNRITTVEKDIKNLSKLSMLSIRENKIKQLPAEIGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 63865 - protein, 195 aa, Homo sapiens
MLRDGRFACAICPHRPVLDTLAMLTAHRAGKKHLSSLQLFYGKKQPGKERKQNPKHQNELRREETKAEAPLLTQTRLITQSALHRAPHYNSCCRRKYRPEAPGPSVSLSPMPPSEVKLQSGKISREPEPAAGPQAEESATVSAPAPMSPTRRRALDHYLTLRSSGWIPDGRGRWVKDENVEFDSDEEEPPDLPLD

SEQ ID NO: 63866 - protein, 230 aa, Homo sapiens
MSFKREGDDWSQLNVLKKRRVGDLLASYIPEDEALMLRDGRFACAICPHRPVLDTLAMLTAHRAGKKHLSSLQLFYGKKQPGKERKQNPKHQNELRREETKAEAPLLTQTRLITQSALHRAPHYNSCCRRKYRPEAPGPSVSLSPMPPSEVKLQSGKISREPEPAAGPQAEESATVSAPAPMSPTRRRALDHYLTLRSSGWIPDGRGRWVKDENVEFDSDEEEPPDLPLD

SEQ ID NO: 63867 - protein, 669 aa, Homo sapiens
MEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 63868 - protein, 691 aa, Homo sapiens
MEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGQVRSLTPVIPALWEAEAGRSRGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 63869 - protein, 685 aa, Homo sapiens
MLLHINPAYLFKLLHGFPPWIMPTDGNLGDKNFQMGKPGHREGATMHVKKYLLKGLHRLQKGPGYTYKELLVWYCDNTNTHGPKRIICEGPKKKAMWFLLTLLFAALVCWQWGIFIRTYLSWEVSVSLSVGFKTMDFPAVTICNASPFKYSKIKHLLKDLDELMEAVLERILAPELSHANATRNLNFSIWNHTPLVLIDERNPHHPMVLDLFGDNHNGLTSSSASEKICNAHGCKMAMRLCSLNRTQCTFRNFTSATQALTEWYILQATNIFAQVPQQELVEMSYPGEQMILACLFGAEPCNYRNFTSIFYPHYGNCYIFNWGMTEKALPSANPGTEFGLKLILDIGQEDYVPFLASTAGVRLMLHEQRSYPFIRDEGIYAMSGTETSIGVLVDKLQRMGEPYSPCTVNGSEVPVQNFYSDYNTTYSIQACLRSCFQDHMIRNCNCGHYLYPLPRGEKYCNNRDFPDWAHCYSDLQMSVAQRETCIGMCKESCNDTQYKMTISMADWPSEASEDWIFHVLSQERDQSTNITLSRKGIVKLNIYFQEFNYRTIEESAANNIVWLLSNLGGQFGFWMGGSVLCLIEFGEIIIDFVWITIIKLVALAKSLRQRRAQASYAGPPPTVAELVEAHTNFGFQPDTAPRSPNTGPYPSEQALPIPGTPPPNYDSLRLQPLDVIESDSEGDAI

SEQ ID NO: 63870 - protein, 640 aa, Homo sapiens
MHVKKYLLKGLHRLQKGPGYTYKELLVWYCDNTNTHGPKRIICEGPKKKAMWFLLTLLFAALVCWQWGIFIRTYLSWEVSVSLSVGFKTMDFPAVTICNASPFKYSKIKHLLKDLDELMEAVLERILAPELSHANATRNLNFSIWNHTPLVLIDERNPHHPMVLDLFGDNHNGLTSSSASEKICNAHGCKMAMRLCSLNRTQCTFRNFTSATQALTEWYILQATNIFAQVPQQELVEMSYPGEQMILACLFGAEPCNYRNFTSIFYPHYGNCYIFNWGMTEKALPSANPGTEFGLKLILDIGQEDYVPFLASTAGVRLMLHEQRSYPFIRDEGIYAMSGTETSIGVLVDKLQRMGEPYSPCTVNGSEVPVQNFYSDYNTTYSIQACLRSCFQDHMIRNCNCGHYLYPLPRGEKYCNNRDFPDWAHCYSDLQMSVAQRETCIGMCKESCNDTQYKMTISMADWPSEASEDWIFHVLSQERDQSTNITLSRKGIVKLNIYFQEFNYRTIEESAANNIVWLLSNLGGQFGFWMGGSVLCLIEFGEIIIDFVWITIIKLVALAKSLRQRRAQASYAGPPPTVAELVEAHTNFGFQPDTAPRSPNTGPYPSEQALPIPGTPPPNYDSLRLQPLDVIESDSEGDAI

SEQ ID NO: 63871 - protein, 704 aa, Homo sapiens
MAFLSRTSPVAAASFQSRQEARGSILLQSCQLPPQWLSTEAWTGEWKQPHGGALTSRSPGPVAPQRPCHLKGWQHRPTQHNAACKQGQAAAQTPPRPGPPSAPPPPPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 63872 - protein, 638 aa, Homo sapiens
MAEHRSMDGRMEAATRGGSHLQAAAQTPPRPGPPSAPPPPPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 63873 - protein, 308 aa, Homo sapiens
  MOD_RES (1)..(1): Any amino acid
XATARAATAFTEATRQAWRLSRTGTTSTMWISWPCCPRHGRTATGARTATSSSPAVTMAWTARPDSSGPSTTPPTAAATRSMASGQLSAPASPTVGASPWPVRGQGCRSGGLTPALGLPGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQS

SEQ ID NO: 63874 - protein, 669 aa, Homo sapiens
MAEHRSMDGRMEAATRGGSHLQIAWACGSPEALPPEGMAAQTHSAQRCLQTGPGCSPDAPQPGPPSAPPPPPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 63875 - protein, 802 aa, Homo sapiens
MRAVLSQKTTPLPRYLWPGHLSGPRRLTWSWCSDHRTPTCRELGSPHPTPCTGPARGWPRRGGGPCGFTSAGHVLCGYPLCLLSGPIQGCGTGLGDSSMAFLSRTSPVAAASFQSRQEARGSILLQSCQLPPQWLSTEAWTGEWKQPHGGALTSRSPGPVAPQRPCHLKGWQHRPTQHNAACKQGQAAAQTPPRPGPPSAPPPPPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 63876 - protein, 638 aa, Homo sapiens; identical to SEQ ID NO: 63872

SEQ ID NO: 63877 - protein, 649 aa, Homo sapiens
MAPGEKIKAKIKKNLPVTGPQAPTIKELMRWYCLNTNTHGCRRIVVSRGRLRRLLWIGFTLTAVALILWQCALLVFSFYTVSVSIKVHFRKLDFPAVTICNINPYKYSTVRHLLADLEQETREALKSLYGFPESRKRREAESWNSVSEGKQPRFSHRIPLLIFDQDEKGKARDFFTGRKRKVGGSIIHKASNVMHIESKQVVGFQLCSNDTSDCATYTFSSGINAIQEWYKLHYMNIMAQVPLEKKINMSYSAEELLVTCFFDGVSCDARNFTLFHHPMHGNCYTFNNRENETILSTSMGGSEYGLQVILYINEEEYNPFLVSSTGAKVIIHRQDEYPFVEDVGTEIETAMVTSIGMHLTESFKLSEPYSQCTEDGSDVPIRNIYNAAYSLQICLHSCFQTKMVEKCGCAQYSQPLPPAANYCNYQQHPNWMYCYYQLHRAFVQEELGCQSVCKEACSFKEWTLTTSLAQWPSVVSEKWLLPVLTWDQGRQVNKKLNKTDLAKLLIFYKDLNQRSIMESPANSIEMLLSNFGGQLGLWMSCSVVCVIEIIEVFFIDFFSIIARRQWQKAKEWWAWKQAPPCPEAPRSPQGQDNPALDIDDDLPTFNSALHLPPALGTQVPGTPPPKYNTLRLERAFSNQLTDTQMLDEL

SEQ ID NO: 63878 - protein, 1980 aa, Homo sapiens
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 63879 - protein, 1557 aa, Homo sapiens
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIV

SEQ ID NO: 63880 - protein, 1195 aa, Homo sapiens
FLSPQTFVVLNRGKTLFRFSATPALYILSPFNLIRRIAIKILIHSLFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVPLNLSGLI

SEQ ID NO: 63881 - protein, 1939 aa, Homo sapiens
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 63882 - protein, 972 aa, Homo sapiens
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYVTEFVDLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVSTNL

SEQ ID NO: 63883 - protein, 2009 aa, Homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 63884 - protein, 1998 aa, Homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 63885 - protein, 1981 aa, Homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 63886 - protein, 2009 aa, Homo sapiens; identical to SEQ ID NO: 63883

SEQ ID NO: 63887 - protein, 218 aa, Homo sapiens
MGRLLALVVGAALVSSACGGCVEVDSETEAVYGMTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKANRDMASIVSEIMMYVLIVVLTIWLVAEMIYCYKKIAAATETAAQENASEYLAITSESKENCTGVQVAE

SEQ ID NO: 63888 - protein, 268 aa, Homo sapiens
MGRLLALVVGAALVSSACGGCVEVDSETEAVYGMTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKGESGAACPFTVTHRRARWRDRWQAVDRTGWLCAWPANRPQQRAEGEGSSPSCPLQLWPLFLSSPRRGQSMPVPHRRSGYRTQLCHLCCMTSGRCLLSLSQRVVLGLPGIIIRCVSRGVV

SEQ ID NO: 63889 - protein, 2005 aa, Homo sapiens
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 63890 - protein, 2005 aa, Homo sapiens
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVNLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 63891 - protein, 2005 aa, Homo sapiens; identical to SEQ ID NO: 63890

SEQ ID NO: 63892 - protein, 2005 aa, Homo sapiens; identical to SEQ ID NO: 63889

SEQ ID NO: 63893 - protein, 503 aa, Homo sapiens
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKN

SEQ ID NO: 63894 - protein, 215 aa, Homo sapiens
MHRDAWLPRPAFSLTGLSLFFSLVPPGRSMEVTVPATLNVLNGSDARLPCTFNSCYTVNHKQFSLNWTYQECNNCSEEMFLQFRMKIINLKLERFQDRVEFSGNPSKYDVSVMLRNVQPEDEGIYNCYIMNPPDRHRGHGKIHLQVLMEEPPERDSTVAVIVGASVGGFLAVVILVLMVVKCVRRKKEQKLSTDDLKTEEEGKTDGEGNPDDGAK

SEQ ID NO: 63895 - protein, 2000 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVDLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 63896 - protein, 2000 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 63897 - protein, 1951 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 63898 - protein, 1364 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVDLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQV

SEQ ID NO: 63899 - protein, 200 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVM

SEQ ID NO: 63900 - protein, 483 aa, Homo sapiens
MVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 63901 - protein, 215 aa, Homo sapiens
MPAFNRLFPLASLVLIYWVSVCFPVCVEVPSETEAVQGNPMKLRCISCMKREEVEATTVVEWFYRPEGGKDFLIYEYRNGHQEVESPFQGRLQWNGSKDLQDVSITVLNVTLNDSGLYTCNVSREFEFEAHRPFVKTTRLIPLRVTEEAGEDFTSVVSEIMMYILLVFLTLWLLIEMIYCYRKVSKAEEAAQENASDYLAIPSENKENSAVPVEE

SEQ ID NO: 63902 - protein, 215 aa, Homo sapiens; identical to SEQ ID NO: 63901

SEQ ID NO: 63903 - protein, 141 aa, Homo sapiens
MPAFNRLFPLASLVLIYWVSVCFPVCVEVPSETEAVQGNPMKLRCISCMKREEVEATTVVEWFYRPEGGKDFLIYEYRNGHQEVESPFQGRLQWNGSKDLQDVSITVLNVTLNDSGLYTCNVSREFEFEAHRPFVKTTRLI

SEQ ID NO: 63904 - protein, 215 aa, Homo sapiens; identical to SEQ ID NO: 63901

SEQ ID NO: 63905 - protein, 1836 aa, Homo sapiens
MARPSLCTLVPLGPECLRPFTRESLAAIEQRAVEEEARLQRNKQMEIEEPERKPRSDLEAGKNLPMIYGDPPPEVIGIPLEDLDPYYSNKKTFIVLNKGKAIFRFSATPALYLLSPFSVVRRGAIKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKKLSDVMILTVFCLSVFALVGLQLFMGNLRQKCVRWPPPFNDTNTTWYSNDTWYGNDTWYGNEMWYGNDSWYANDTWNSHASWATNDTFDWDAYISDEGNFYFLEGSNDALLCGNSSDAGHCPEGYECIKTGRNPNYGYTSYDTFSWAFLALFRLMTQDYWENLFQLTLRAAGKTYMIFFVVIIFLGSFYLINLILAVVAMAYAEQNEATLAEDKEKEEEFQQMLEKFKKHQEELEKAKAAQALEGGEADGDPAHGKDCNGSLDTSQGEKGAPRQSSSGDSGISDAMEELEEAHQKCPPWWYKCAHKVLIWNCCAPWLKFKNIIHLIVMDPFVDLGITICIVLNTLFMAMEHYPMTEHFDNVLTVGNLVFTGIFTAEMVLKLIAMDPYEYFQQGWNIFDSIIVTLSLVELGLANVQGLSVLRSFRLLRVFKLAKSWPTLNMLIKIIGNSVGALGNLTLVLAIIVFIFAVVGMQLFGKSYKECVCKIALDCNLPRWHMHDFFHSFLIVFRILCGEWIETMWDCMEVAGQAMCLTVFLMVMVIGNLVVLNLFLALLLSSFSADSLAASDEDGEMNNLQIAIGRIKLGIGFAKAFLLGLLHGKILSPKDIMLSLGEADGAGEAGEAGETAPEDEKKEPPEEDLKKDNHILNHMGLADGPPSSLELDHLNFINNPYLTIQVPIASEESDLEMPTEEETDTFSEPEDSKKPPQPLYDGNSSVCSTADYKPPEEDPEEQAEENPEGEQPEECFTEACVQRWPCLYVDISQGRGKKWWTLRRACFKIVEHNWFETFIVFMILLSSGALAFEDIYIEQRRVIRTILEYADKVFTYIFIMEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCINTTTSERFDISEVNNKSECESLMHTGQVRWLNVKVNYDNVGLGYLSLLQVATFKGWMDIMYAAVDSREKEEQPQYEVNLYMYLYFVIFIIFGSFFTLNLFIGVIIDNFNQQKKKLGGKDIFMTEEQKKYYNAMKKLGSKKPQKPIPRPQNKIQGMVYDLVTKQAFDITIMILICLNMVTMMVETDNQSQLKVDILYNINMIFIIIFTGECVLKMLALRQYYFTVGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPNLENPGTSVKGDCGNPSIGICFFCSYIIISFLIVVNMYIAIILENFNVATEESSEPLGEDDFEMFYETWEKFDPDATQFIAYSRLSDFVDTLQEPLRIAKPNKIKLITLDLPMVPGDKIHCLDILFALTKEVLGDSGEMDALKQTMEEKFMAANPSKVSYEPITTTLKRKHEEVCAIKIQRAYRRHLLQRSMKQASYMYRHSHDGSGDDAPEKEGLLANTMSKMYGHENGNSSSPSPEEKGEAGDAGPTMGLMPISPSDTAWPPAPPPGQTVRPGVKESLV

SEQ ID NO: 63906 - protein, 228 aa, Homo sapiens
MPGAGDGGKAPARWLGTGLLGLFLLPVTLSLEVSVGKATDIYAVNGTEILLPCTFSSCFGFEDLHFRWTYNSSDAFKILIEGTVKNEKSDPKVTLKDDDRITLVGSTKEKMNNISIVLRDLEFSDTGKYTCHVKNPKENNLQHHATIFLQVVDRLEEVDNTVTLIILAVVGGVIGLLILILLIKKLIIFILKKTREKKKECLVSSSGNDNTENGLPGSKAEEKPPSKV

SEQ ID NO: 63907 - protein, 94 aa, Homo sapiens
MPGAGDGGKAPARWLGTGLLVEEVDNTVTLIILAVVGGVIGLLILILLIKKLIIFILKKTREKKKECLVSSSGNDNTENGLPGSKAEEKPPSKV

SEQ ID NO: 63908 - protein, 1989 aa, Homo sapiens
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSTLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEVIIDKATSDDSGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVWRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 63909 - protein, 1989 aa, Homo sapiens
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSTLFSMLIMCTILTNCIFMTMNNPPDWTKNVEYTFTGIYTFESLVKILARGFCVGEFTFLRDPWNWLDFVVIVFAYVTEFVDLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEVIIDKATSDDSGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVWRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 63910 - protein, 1988 aa, Homo sapiens
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEVIIDKATSDDSGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVWRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 63911 - protein, 1977 aa, Homo sapiens
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVWRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 63912 - protein, 539 aa, Homo sapiens
ILTNCIFMTMNNPPDWTKNVEYTFTGIYTFESLVKILARGFCVGEFTFLRDPWNWLDFVVIVFAYVTEFVDLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEVIIDKATSDDSGTTNQIHKKRRCSSYL

SEQ ID NO: 63913 - protein, 65 aa, Homo sapiens
MANFLLPRGTSSFRRFTRESLAAIEKRMAEKQARGSTTLQESREGLPEEEAPRPQLDLQASKKLP

SEQ ID NO: 63914 - protein, 2016 aa, Homo sapiens [sequence omitted]

SEQ ID NO: 63915 - protein, 113 aa, Homo sapiens
MAQHDPPPWTKYVEYVSENIKLGNLSALRTFRVLRALKTISVIPGLKTIVGALIQSVKKLADVMVLTVFCLSVFALIGLQLFMGNLRHKCVRNFTALNGTNGSVEADGLVWES

SEQ ID NO: 63916 - protein, 2016 aa, Homo sapiens
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYVSENIKLGNLSALRTFRVLRALKTISVIPGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTAGESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRQRPQKPAALAAQGQLPSCIATPYSPPPPETEKVPPTRKETRFEEGEQPGQGTPGDPEPVCVPIAVAESDTDDQEEDEENSLGTEEESSKQQESQPVSGGPEAPPDSRTWSQVSATASSEAEASASQADWRQQWKAEPQAPGCGETPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVATFKGWMDIMYAAVDSRGYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGECIVKLAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 63917 - protein, 1998 aa, Homo sapiens
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYVSENIKLGNLSALRTFRVLRALKTISVIPGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTAGESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRQRPQKPAALAAQGQLPSCIATPYSPPPPETEKVPPTRKETRFEEGEQPGQGTPGDPEPVCVPIAVAESDTDDQEEDEENSLGTEEESSKQQESQPVSGGPEAPPDSRTWSQVSATASSEAEASASQADWRQQWKAEPQAPGCGETPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGECIVKLAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 63918 - protein, 2015 aa, Homo sapiens [sequence omitted]

SEQ ID NO: 63919 - protein, 1998 aa, Homo sapiens; identical to SEQ ID NO: 63917

SEQ ID NO: 63920 - protein, 2015 aa, Homo sapiens [sequence omitted]

SEQ ID NO: 63921 - protein, 1962 aa, Homo sapiens
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYTTEFVDLGNVSALRTFRVLRALKTISVISGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTAGESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRQRPQKPAALAAQGQLPSCIATPYSPPPPETEKVPPTRKETRFEEGEQPGQGTPGDPEPVCVPIAVAESDTDDQEEDEENSLGTEEESSKQTPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVATFKGWMDIMYAAVDSRGYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGECIVKLAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 63922 - protein, 1962 aa, Homo sapiens
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYVSENIKLGNLSALRTFRVLRALKTISVIPGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTAGESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRQRPQKPAALAAQGQLPSCIATPYSPPPPETEKVPPTRKETRFEEGEQPGQGTPGDPEPVCVPIAVAESDTDDQEEDEENSLGTEEESSKQTPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVATFKGWMDIMYAAVDSRGYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGECIVKLAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 63923 - protein, 1962 aa, Homo sapiens; identical to SEQ ID NO: 63922

SEQ ID NO: 63924 - protein, 1983 aa, Homo sapiens
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYVSENIKLGNLSALRTFRVLRALKTISVIPGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTAGESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRQRPQKPAALAAQGQLPSCIATPYSPPPPETEKVPPTRKETRFEEGEQPGQGTPGDPEPVCVPIAVAESDTDDQEEDEENSLGTEEESSKQESQPVSGGPEAPPDSRTWSQVSATASSEAEASASQADWRQQWKAEPQAPGCGETPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVATFKGWMDIMYAAVDSRGYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 63925 - protein, 1682 aa, Homo sapiens
MLASPEPKGLVPFTKESFELIKQHIAKTHNEDHEEEDLKPTPDLEVGKKLPFIYGNLSQGMVSEPLEDVDPYYYKKKNTFIVLNKNRTIFRFNAASILCTLSPFNCIRRTTIKVLVHPFFQLFILISVLIDCVFMSLTNLPKWRPVLENTLLGIYTFEILVKLFARGVWAGSFSFLGDPWNWLDFSVTVFEVIIRYSPLDFIPTLQTARTLRILKIIPLNQGLKSLVGVLIHCLKQLIGVIILTLFFLSIFSLIGMGLFMGNLKHKCFRWPQENENETLHNRTGNPYYIRETENFYYLEGERYALLCGNRTDAGQCPEGYVCVKAGINPDQGFTNFDSFGWALFALFRLMAQDYPEVLYHQILYASGKVYMIFFVVVSFLFSFYMASLFLGILAMAYEEEKQRVGEISKKIEPKFQQTGKELQEGNETDEAKTIQIEMKKRSPISTDTSLDVLEDATLRHKEELEKSKKICPLYWYKFAKTFLIWNCSPCWLKLKEFVHRIIMAPFTDLFLIICIILNVCFLTLEHYPMSKQTNTLLNIGNLVFIGIFTAEMIFKIIAMHPYGYFQVGWNIFDSMIVFHGLIELCLANVAGMALLRLFRMLRIFKLGKYWPTFQILMWSLSNSWVALKDLVLLLFTFIFFSAAFGMKLFGKNYEEFVCHIDKDCQLPRWHMHDFFHSFLNVFRILCGEWVETLWDCMEVAGQSWCIPFYLMVILIGNLLVLYLFLALVSSFSSCKDVTAEENNEAKNLQLAVARIKKGINYVLLKILCKTQNVPKDTMDHVNEVYVKEDISDHTLSELSNTQDFLKDKEKSSGTEKNATENESQSLIPSPSVSETVPIASGESDIENLDNKEIQSKSGDGGSKEKIKQSSSSECSTVDIAISEEEEMFYGGERSKHLKNGCRRGSSLGQISGASKKGKIWQNIRKTCCKIVENNWFKCFIGLVTLLSTGTLAFEDIYMDQRKTIKILLEYADMIFTYIFILEMLLKWMAYGFKAYFSNGWYRLDFVVVIVFCLSLIGKTREELKPLISMKFLRPLRVLSQFERMKVVVRALIKTTLPTLNVFLVCLMIWLIFSIMGVDLFAGRFYECIDPTSGERFPSSEVMNKSRCESLLFNESMLWENAKMNFDNVGNGFLSLLQVATFNGWITIMNSAIDSVAVNIQPHFEVNIYMYCYFINFIIFGVFLPLSMLITVIIDNFNKHKIKLGGSNIFITVKQRKQYRRLKKLMYEDSQRPVPRPLNKLQGFIFDVVTSQAFNVIVMVLICFQAIAMMIDTDVQSLQMSIALYWINSIFVMLYTMECILKLIAFRCFYFTIAWNIFDFMVVIFSITGLCLPMTVGSYLVPPSLVQLILLSRIIHMLRLGKGPKVFHNLMLPLMLSLPALLNIILLIFLVMFIYAVFGMYNFAYVKKEAGINDVSNFETFGNSMLCLFQVAIFAGWDGMLDAIFNSKWSDCDPDKINPGTQVRGDCGNPSVGIFYFVSYILISWLIIVNMYIVVVMEFLNIASKKKNKTLSEDDFRKFFQVWKRFDPDRTQYIDSSKLSDFAAALDPPLFMAKPNKGQLIALDLPMAVGDRIHCLDILLAFTKRVMGQDVRMEKVVSEIESGFLLANPFKITCEPITTTLKRKQEAVSATIIQRAYKNYRLRRNDKNTSDIHMIDGDRDVHATKEGAYFDKAKEKSPIQSQI

SEQ ID NO: 63926 - protein, 1682 aa, Homo sapiens; identical to SEQ ID NO: 63925

SEQ ID NO: 63927 - protein, 863 aa, Homo sapiens
MLASPEPKGLVPFTKESFELIKQHIAKTHNEDHEEEDLKPTPDLEVGKKLPFIYGNLSQGMVSEPLEDVDPYYYKKKNTFIVLNKNRTIFRFNAASILCTLSPFNCIRRTTIKVLVHPFFQLFILISVLIDCVFMSLTNLPKWRPVLENTLLGIYTFEILVKLFARGVWAGSFSFLGDPWNWLDFSVTVFEVIIRYSPLDFIPTLQTARTLRILKIIPLNQGLKSLVGVLIHCLKQLIGVIILTLFFLSIFSLIGMGLFMGNLKHKCFRWPQENENETLHNRTGNPYYIRETENFYYLEGERYALLCGNRTDAGQCPEGYVCVKAGINPDQGFTNFDSFGWALFALFRLMAQDYPEVLYHQILYASGKVYMIFFVVVSFLFSFYMASLFLGILAMAYEEEKQRVGEISKKIEPKFQQTGKELQEGNETDEAKTIQIEMKKRSPISTDTSLDVLEDATLRHKEELEKSKKICPLYWYKFAKTFLIWNCSPCWLKLKEFVHRIIMAPFTDLFLIICIILNVCFLTLEHYPMSKQTNTLLNIGNLVFIGIFTAEMIFKIIAMHPYGYFQVGWNIFDSMIVFHGLIELCLANVAGMALLRLFRMLRIFKLGKYWPTFQILMWSLSNSWVALKDLVLLLFTFIFFSAAFGMKLFGKNYEEFVCHIDKDCQLPRWHMHDFFHSFLNVFRILCGEWVETLWDCMEVAGQSWCIPFYLMVILIGNLLVLYLFLALVSSFSSCKDVTAEENNEAKNLQLAVARIKKGINYVLLKILCKTQNVPKDTMDHVNEVYVKEDISDHTLSELSNTQDFLKDKEKSSGTEKNATENESQSLIPSPSVSETVPIASGESDIENLDNKEIQSKSGDGGSK

SEQ ID NO: 63928 - protein, 402 aa, Homo sapiens
MLASPEPKGLVPFTKESFELIKQHIAKTHNEDHEEEDLKPTPDLEVGKKLPFIYGNLSQGMVSEPLEDVDPYYYKKKNTFIVLNKNRTIFRFNAASILCTLSPFNCIRRTTIKVLVHPFFQLFILISVLIDCVFMSLTNLPKWRPVLENTLLGIYTFEILVKLFARGVWAGSFSFLGDPWNWLDFSVTVFEVIIRYSPLDFIPTLQTARTLRILKIIPLNQGLKSLVGVLIHCLKQLIGVIILTLFFLSIFSLIGMGLFMGNLKHKCFRWPQENENETLHNRTGNPYYIRETENFYYLEGERYALLCGNRTDAGQCPEGYVCVKAGINPDQGFTNFDSFGWALFALFRLMAQDYPEVLYHQILYASGKVYMIFFVVVSFLFSFYMASLFLGILAMAYEEEKQ

SEQ ID NO: 63929 - protein, 1956 aa, Homo sapiens
MEFPIGSLETNNFRRFTPESLVEIEKQIAAKQGTKKAREKHREQKDQEEKPRPQLDLKACNQLPKFYGELPAELIGEPLEDLDPFYSTHRTFMVLNKGRTISRFSATRALWLFSPFNLIRRTAIKVSVHSWFSLFITVTILVNCVCMTRTDLPEKIEYVFTVIYTFEALIKILARGFCLNEFTYLRDPWNWLDFSVITLAYVGTAIDLRGISGLRTFRVLRALKTVSVIPGLKVIVGALIHSVKKLADVTILTIFCLSVFALVGLQLFKGNLKNKCVKNDMAVNETTNYSSHRKPDIYINKRGTSDPLLCGNGSDSGHCPDGYICLKTSDNPDFNYTSFDSFAWAFLSLFRLMTQDSWERLYQQTLRTSGKIYMIFFVLVIFLGSFYLVNLILAVVTMAYEEQNQATTDEIEAKEKKFQEALEMLRKEQEVLAALGIDTTSLHSHNGSPLTSKNASERRHRIKPRVSEGSTEDNKSPRSDPYNQRRMSFLGLASGKRRASHGSVFHFRSPGRDISLPEGVTDDGVFPGDHESHRGSLLLGGGAGQQGPLPRSPLPQPSNPDSRHGEDEHQPPPTSELAPGAVDVSAFDAGQKKTFLSAEYLDEPFRAQRAMSVVSIITSVLEELEESEQKCPPCLTSLSQKYLIWDCCPMWVKLKTILFGLVTDPFAELTITLCIVVNTIFMAMEHHGMSPTFEAMLQIGNIVFTIFFTAEMVFKIIAFDPYYYFQKKWNIFDCIIVTVSLLELGVAKKGSLSVLRSFRLLRVFKLAKSWPTLNTLIKIIGNSVGALGNLTIILAIIVFVFALVGKQLLGENYRNNRKNISAPHEDWPRWHMHDFFHSFLIVFRILCGEWIENMWACMEVGQKSICLILFLTVMVLGNLVVLNLFIALLLNSFSADNLTAPEDDGEVNNLQVALARIQVFGHRTKQALCSFFSRSCPFPQPKAEPELVVKLPLSSSKAENHIAANTARGSSGGLQAPRGPRDEHSDFIANPTVWVSVPIAEGESDLDDLEDDGGEDAQSFQQEVIPKGQQEQLQQVERCGDHLTPRSPGTGTSSEDLAPSLGETWKDESVPQVPAEGVDDTSSSEGSTVDCLDPEEILRKIPELADDLEEPDDCFTEGCIRHCPCCKLDTTKSPWDVGWQVRKTCYRIVEHSWFESFIIFMILLSSGSLAFEDYYLDQKPTVKALLEYTDRVFTFIFVFEMLLKWVAYGFKKYFTNAWCWLDFLIVNISLISLTAKILEYSEVAPIKALRTLRALRPLRALSRFEGMRVVVDALVGAIPSIMNVLLVCLIFWLIFSIMGVNLFAGKFWRCINYTDGEFSLVPLSIVNNKSDCKIQNSTGSFFWVNVKVNFDNVAMGYLALLQVATFKGWMDIMYAAVDSREVNMQPKWEDNVYMYLYFVIFIIFGGFFTLNLFVGVIIDNFNQQKKKLGGQDIFMTEEQKKYYNAMKKLGSKKPQKPIPRPLNKFQGFVFDIVTRQAFDITIMVLICLNMITMMVETDDQSEEKTKILGKINQFFVAVFTGECVMKMFALRQYYFTNGWNVFDFIVVVLSIASLIFSAILKSLQSYFSPTLFRVIRLARIGRILRLIRAAKGIRTLLFALMMSLPALFNIGLLLFLVMFIYSIFGMSSFPHVRWEAGIDDMFNFQTFANSMLCLFQITTSAGWDGLLSPILNTGPPYCDPNLPNSNGTRGDCGSPAVGIIFFTTYIIISFLIMVNMYIAVILENFNVATEESTEPLSEDDFDMFYETWEKFDPEATQFITFSALSDFADTLSGPLRIPKPNRNILIQMDLPLVPGDKIHCLDILFAFTKNVLGESGELDSLKANMEEKFMATNLSKSSYEPIATTLRWKQEDISATVIQKAYRSYVLHRSMALSNTPCVPRAEEEAASLPDEGFVAFTANENCVLPDKSETASATSFPPSYESVTRGLSDRVNMRTSSSIQNEDEATSMELIAPGP

SEQ ID NO: 63930 - protein, 1791 aa, Homo sapiens
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGSLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSTMISTLENQEHIPFPPTLFRIVRLARIGRILRLVRAARGIRTLLFALMMSLPSLFNIGLLLFLIMFIYAILGMNWFSKVNPESGIDDIFNFKTFASSMLCLFQISTSAGWDSLLSPMLRSKESCNSSSENCHLPGIATSYFVSYIIISFLIVVNMYIAVILENFNTATEESEDPLGEDDFDIFYEVWEKFDPEATQFIKYSALSDFADALPEPLRVAKPNKYQFLVMDLPMVSEDRLHCMDILFAFTARVLGGSDGLDSMKAMMEEKFMEANPLKKLYEPIVTTTKRKEEERGAAIIQKAFRKYMMKVTKGDQGDQNDLENGPHSPLQTLCNGDLSSFGVAKGKVHCD

SEQ ID NO: 63931 - protein, 1444 aa, Homo sapiens
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGSLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSK

SEQ ID NO: 63932 - protein, 1791 aa, Homo sapiens; identical to SEQ ID NO: 63930

SEQ ID NO: 63933 - protein, 1738 aa, Homo sapiens
MLKRKQSSRVEAQPVTDFGPDESLSDNADILWINKPWVHSLLRICAIISVISVCMNTPMTFEHYPPLQYVTFTLDTLLMFLYTAEMIAKMHIRGIVKGDSSYVKDRWCVFDGFMVFCLWVSLVLQVFEIADIVDQMSPWGMLRIPRPLIMIRAFRIYFRFELPRTRITNILKRSGEQIWSVSIFLLFFLLLYGILGVQMFGTFTYHCVVNDTKPGNVTWNSLAIPDTHCSPELEEGYQCPPGFKCMDLEDLGLSRQELGYSGFNEIGTSIFTVYEAASQEGWVFLMYRAIDSFPRWRSYFYFITLIFFLAWLVKNVFIAVIIETFAEIRVQFQQMWGSRSSTTSTATTQMFHEDAAGGWQLVAVDVNKPQGRAPACLQKMMRSSVFHMFILSMVTVDVIVAASNYYKGENFRRQYDEFYLAEVAFTVLFDLEALLKIWCLGFTGYISSSLHKFELLLVIGTTLHVYPDLYHSQFTYFQVLRVVRLIKISPALEDFVYKIFGPGKKLGSLVVFTASLLIVMSAISLQMFCFVEELDRFTTFPRAFMSMFQILTQEGWVDVMDQTLNAVGHMWAPVVAIYFILYHLFATLILLSLFVAVILDNLELDEDLKKLKQLKQSEANADTKEKLPLRLRIFEKFPNRPQMVKISKLPSDFTVPKIRESFMKQFIDRQQQDTCCLLRSLPTTSSSSCDHSKRSAIEDNKYIDQKLRKSVFSIRARNLLEKETAVTKILRACTRQRMLSGSFEGQPAKERSILSVQHHIRQERRSLRHGSNSQRISRGKSLETLTQDHSNTVRYRNAQREDSEIKMIQEKKEQAEMKRKVQEEELRENHPYFDKPLFIVGREHRFRNFCRVVVRARFNASKTDPVTGAVKNTKYHQLYDLLGLVTYLDWVMIIVTICSCISMMFESPFRRVMHAPTLQIAEYVFVIFMSIELNLKIMADGLFFTPTAVIRDFGGVMDIFIYLVSLIFLCWMPQNVPAESGAQLLMVLRCLRPLRIFKLVPQMRKVVRELFSGFKEIFLVSILLLTLMLVFASFGVQLFAGKLAKCNDPNIIRREDCNGIFRINVSVSKNLNLKLRPGEKKPGFWVPRVWANPRNFNFDNVGNAMLALFEVLSLKGWVEVRDVIIHRVGPIHGIYIHVFVFLGCMIGLTLFVGVVIANFNENKGTALLTVDQRRWEDLKSRLKIAQPLHLPPRPDNDGFRAKMYDITQHPFFKRTIALLVLAQSVLLSVKWDVEDPVTVPLATMSVVFTFIFVLEVTMKIIAMSPAGFWQSRRNRYDLLVTSLGVVWVVLHFALLNAYTYMMGACVIVFRFFSICGKHVTLKMLLLTVVVSMYKSFFIIVGMFLLLLCYAFAGVVLFGTVKYGENINRHANFSSAGKAITVLFRIVTGEDWNKIMHDCMVQPPFCTPDEFTYWATDCGNYAGALMYFCSFYVIIAYIMLNLLVAIIVENFSLFYSTEEDQLLSYNDLRHFQIIWNMVDDKREGVIPTFRVKFLLRLLRGRLEVDLDKDKLLFKHMCYEMERLHNGGDVTFHDVLSMLSYRSVDIRKSLQLEELLAREQLEYTIEEEVAKQTIRMWLKKCLKRIRAKQQQSCSIIHSLRESQQQELSRFLNPPSIETTQPSEDTNANSQDNSMQPETSSQQQLLSPTLSDRGGSRQDAADAGKPQRKFGQWRLPSAPKPISHSVSSVNLRFGGRTTMKSVVCKMNPMTDAASCGSEVKKWWTRQLTVESDESGDDLLDI

SEQ ID NO: 63934 - protein, 668 aa, Homo sapiens
MLKRKQSSRVEAQPVTDFGPDESLSDNADILWINKPWVHSLLRICAIISVISVCMNTPMTFEHYPPLQYVTFTLDTLLMFLYTAEMIAKMHIRGIVKGDSSYVKDRWCVFDGFMVFCLWVSLVLQVFEIADIVDQMSPWGMLRIPRPLIMIRAFRIYFRFELPRTRITNILKRSGEQIWSVSIFLLFFLLLYGILGVQMFGTFTYHCVVNDTKPGNVTWNSLAIPDTHCSPELEEGYQCPPGFKCMDLEDLGLSRQELGYSGFNEIGTSIFTVYEAASQEGWVFLMYRAIDSFPRWRSYFYFITLIFFLAWLVKNVFIAVIIETFAEIRVQFQQMWGSRSSTTSTATTQMFHEDAAGGWQLVAVDVNKPQGRAPACLQKMMRSSVFHMFILSMVTVDVIVAASNYYKGENFRRQYDEFYLAEVAFTVLFDLEALLKIWCLGFTGYISSSLHKFELLLVIGTTLHVYPDLYHSQFTYFQVLRVVRLIKISPALEDFVYKIFGPGKKLGSLVVFTASLLIVMSAISLQMFCFVEELDRFTTFPRAFMSMFQILTQEGWVDVMDQTLNAVGHMWAPVVAIYFILYHLFATLPPSLIRDLCGTQDACPSCLPLQPPNPLPGSQTLARLTHQALTTPPGMRSSQLFSKISLLLGICVAWESILGSLSLSHNLR

SEQ ID NO: 63935 - protein, 218 aa, Homo sapiens
MLKRKQSSRVEAQPVTDFGPDESLSDNADILWINKPWVHSLLRICAIISVISVCMNTPMTFEHYPPLQYVTFTLDTLLMFLYTAEMIAKMHIRGIVKGDSSYVKDRWCVFDGFMVFCLWVSLVLQVFEIADIVDQMSPWGMLRIPRPLIMIRAFRIYFRFELPRTRITNILKRSGEQIWSVSIFLLFFLLLYGILGVQMFGTFTYHCVVNDTKPGLSL

SEQ ID NO: 63936 - protein, 218 aa, Homo sapiens
MLKRKQSSRVEAQPVTDFGPDESLSDNADILWINKPWVHSLLRICAIISVISVCMNTPMTFEHYPPLQYVTFTLDTLLMFLYTAEMIAKMHIRGIVKGDSSYVKDRWCVFDGFMVFCLWVSLVLQVFEIADIVDQMSPWGMLRIPRPLIMIRAFRIYFRFELPRTRITNILKRSGEQIWSVSIFLLFFLLLYGILGVQMFGTFTYHCVVNDTKPGLSI

SEQ ID NO: 63937 - protein, 574 aa, Homo sapiens
MASTEGANNMPKQVEVRMHDSHLGSEEPKHRHLGLRLCDKLGKNLLLTLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPPDEEANATSAVVSLLNETVTEVPEETKMVIKKGLEFKDGMNVLGLIGFFIAFGIAMGKMGDQAKLMVDFFNILNEIVMKLVIMIMWYSPLGIACLICGKIIAIKDLEVVARQLGMYMVTVIIGLIIHGGIFLPLIYFVVTRKNPFSFFAGIFQAWITALGTASSAGTLPVTFRCLEENLGIDKRVTRFVLPVGATINMDGTALYEAVAAIFIAQMNGVVLDGGQIVTVSLTATLASVGAASIPSAGLVTMLLILTAVGLPTEDISLLVAVDWLLDRMRTSVNVVGDSFGAGIVYHLSKSELDTIDSQHRVHEDIEMTKTQSIYDDMKNHRESNSNQCVYAAHNSVIVDECKVTLAANGKSADCSVEEEPWKREK

SEQ ID NO: 63938 - protein, 565 aa, Homo sapiens
MPKQVEVRMHDSHLGSEEPKHRHLGLRLCDKLGKNLLLTLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPPDEEANATSAVVSLLNETVTEVPEETKMVIKKGLEFKDGMNVLGLIGFFIAFGIAMGKMGDQAKLMVDFFNILNEIVMKLVIMIMWYSPLGIACLICGKIIAIKDLEVVARQLGMYMVTVIIGLIIHGGIFLPLIYFVVTRKNPFSFFAGIFQAWITALGTASSAGTLPVTFRCLEENLGIDKRVTRFVLPVGATINMDGTALYEAVAAIFIAQMNGVVLDGGQIVTVSLTATLASVGAASIPSAGLVTMLLILTAVGLPTEDISLLVAVDWLLDRMRTSVNVVGDSFGAGIVYHLSKSELDTIDSQHRVHEDIEMTKTQSIYDDMKNHRESNSNQCVYAAHNSVIVDECKVTLAANGKSADCSVEEEPWKREK

SEQ ID NO: 63939 - protein, 565 aa, Homo sapiens; identical to SEQ ID NO: 63938

SEQ ID NO: 63940 - protein, 542 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 63941 - protein, 497 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITIRDRLRTTTNVLGDSLGAGIVEHLSRHELKNRDVEMGNSVIEENEMKKPYQLIAQDNETEKPIDSETKM

SEQ ID NO: 63942 - protein, 115 aa, Homo sapiens
MTKSNGEEPKMGGRMERFQQGVRKRTLLAKKKVQNITKEDVKSYLFRNAFVLLTVTAVIVDEKTEAQILTTQLMNTEWDSNPPFRLQVLIHHTVLGAITPILALLQQFAEGLPEV

SEQ ID NO: 63943 - protein, 490 aa, Homo sapiens
MTKSNGEEPKMGGRMERFQQGVRKRTLLAKKKVQNITKEDVKSYLFRNAFVLLTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 63944 - protein, 107 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTG

SEQ ID NO: 63945 - protein, 107 aa, Homo sapiens; identical to SEQ ID NO: 63944

SEQ ID NO: 63946 - protein, 101 aa, Homo sapiens
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLII

SEQ ID NO: 63947 - protein, 532 aa, Homo sapiens
MEKSNETNGYLDSAQAGPAAGPGAPGTAAGRARRCAGFLRRQALVLLTVSGVLAGAGLGAALRGLSLSRTQVTYLAFPGEMLLRMLRMIILPLVVCSLVSGAASLDASCLGRLGGIAVAYFGLTTLSASALAVALAFIIKPGSGAQTLQSSDLGLEDSGPPPVPKETVDSFLDLARNLFPSNLVVAAFRTYATDYKVVTQNSSSGNVTHEKIPIGTEIEGMNILGLVLFALVLGVALKKLGSEGEDLIRFFNSLNEATMVLVSWIMWYVPVGIMFLVGSKIVEMKDIIVLVTSLGKYIFASILGHVIHGGIVLPLIYFVFTRKNPFRFLLGLLAPFATAFATCSSSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 63948 - protein, 452 aa, Homo sapiens
MLLRMLRMIILPLVVCSLVSGAASLDASCLGRLGGIAVAYFGLTTLSASALAVALAFIIKPGSGAQTLQSSDLGLEDSGPPPVPKETVDSFLDLARNLFPSNLVVAAFRTYATDYKVVTQNSSSGNVTHEKIPIGTEIEGMNILGLVLFALVLGVALKKLGSEGEDLIRFFNSLNEATMVLVSWIMWYVPVGIMFLVGSKIVEMKDIIVLVTSLGKYIFASILGHVIHGGIVLPLIYFVFTRKNPFRFLLGLLAPFATAFATCSSSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 63949 - protein, 234 aa, Homo sapiens
MNILGLVLFALVLGVALKKLGSEGEDLIRFFNSLNEATMVLVSWIMCSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 63950 - protein, 524 aa, Homo sapiens
MGKPARKGCEWKRFLKNNWVLLSTVAAVVLGITTGVLVREHSNLSTLEKFYFAFPGEILMRMLKLIILPLIISSMITGVAALDSNVSGKIGLRAVVYYFCTTLIAVILGIVLVVSIKPGVTQKVGEIARTGSTPEVSTVDAMLDLIRNMFPENLVQACFQQYKTKREEVKPPSDPEMNMTEESFTAVMTTAISKNKTKEYKIVGMYSDGINVLGLIVFCLVFGLVIGKMGEKGQILVDFFNALSDATMKIVQIIMCYMPLGILFLIAGKIIEVEDWEIFRKLGLYMATVLTGLAIHSIVILPLIYFIVVRKNPFRFAMGMAQALLTALMISSSSATLPVTFRCAEENNQVDKRITRFVLPVGATINMDGTALYEAVAAVFIAQLNDLDLGIGQIITISITATSASIGAAGVPQAGLVTMVIVLSAVGLPAEDVTLIIAVDWLLDRFRTMVNVLGDAFGTGIVEKLSKKELEQMDVSSEVNIVNPFALESTILDNEDSDTKKSYVNGGFAVDKSDTISFTQTSQF

SEQ ID NO: 63951 - protein, 242 aa, Homo sapiens
  MOD_RES (1)..(1): Any amino acid
XFFNALSDATMKIVQIIMCYMPLGILFLIAGKIIEVEDWEIFRKLGLYMATVLTGLAIHSIVILPLIYFIVVRKNPFRFAMGMAQALLTALMISSSSATLPVTFRCAEENNQVDKRITRFVLPVGATINMDGTALYEAVAAVFIAQLNDLDLGIGQIITIRDRFRTMVNVLGDAFGTGIVEKLSKKELEQMDVSSEVNIVNPFALESTILDNEDSDTKKSYVNGGFAVDKSDTISFTQTSQF

SEQ ID NO: 63952 - protein, 548 aa, Homo sapiens
ETPVLPIMVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 63953 - protein, 313 aa, Homo sapiens
MNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 63954 - protein, 339 aa, Homo sapiens
MYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 63955 - protein, 541 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 63956 - protein, 349 aa, Homo sapiens
MEAHNASAPFNFTLPPNFGKRPTDLALSVILVFMLFFIMLSLGCTMEFSKIKAHLWKPKGLAIALVAQYGIMPLTAFVLGKVFRLKNIEALAILVCGCSPGGNLSNVFSLAMKGDMNLSIVMTTCSTFCALGMMPLLLYIYSRGIYDGDLKDKVPYKGIVISLVLVLIPCTIGIVLKSKRPQYMRYVIKGGMIIILLCSVAVTVLSAINVGKSIMFAMTPLLIATSSLMPFIGFLLGYVLSALFCLNGRCRRTVSMETGCQNVQLCSTILNVAFPPEVIGPLFFFPLLYMIFQLGEGLLLIAIFWCYEKFKTPKDKTKMIYTAATTEETIPGALGNGTYKGEDCSPCTA

SEQ ID NO: 63957 - protein, 348 aa, Homo sapiens
MNDPNSCVDNATVCSGASCVVPESNFNNILSVVLSTVLTILLALVMFSMGCNVEIKKFLGHIKRPWGICVGFLCQFGIMPLTGFILSVAFDILPLQAVVVLIIGCCPGGTASNILAYWVDGDMDLSVSMTTCSTLLALGMMPLCLLIYTKMWVDSGSIVIPYDNIGTSLVSLVVPVSIGMFVNHKWPQKAKIILKIGSIAGAILIVLIAVVGGILYQSAWIIAPKLWIIGTIFPVAGYSLGFLLARIAGLPWYRCRTVAFETGMQNTQLCSTIVQLSFTPEELNVVFTFPLIYSIFQLAFAAIFLGFYVAYKKCHGKNKAEIPESKENGTEPESSFYKANGGFQPDEK

SEQ ID NO: 63958 - protein, 477 aa, Homo sapiens
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 63959 - protein, 448 aa, Homo sapiens
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 63960 - protein, 532 aa, Homo sapiens
MAGPRPPGDSPAIKEDSTGLGPTHEPFSGQPNSTSGDVLLSRRGPGHAIRPPGRAMVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 63961 - protein, 477 aa, Homo sapiens; identical to SEQ ID NO: 63958

SEQ ID NO: 63962 - protein, 218 aa, Homo sapiens
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKG

SEQ ID NO: 63963 - protein, 437 aa, Homo sapiens
MDGNDNVTLLFAPLLRDNYTLAPNASSLGPGTDLALAPASSAGPGPGLSLGPGPSFGFSPGPTPTPEPTTSGLAGGAASHGPSPFPRPWAPHALPFWDTPLNHGLNVFVGAALCITMLGLGCTVDVNHFGAHVRRPVGALLAALCQFGLLPLLAFLLALAFKLDEVAAVAVLLCGCCPGGNLSNLMSLLVDGDMNLSIIMTISSTLLALVLMPLCLWIYSWAWINTPIVQLLPLGTVTLTLCSTLIPIGLGVFIRYKYSRVADYIVKVSLWSLLVTLVVLFIMTGTMLGPELLASIPAAVYVIAIFMPLAGYASGYGLATLFHLPPNCKRTVCLETGSQNVQLCTAILKLAFPPQFIGSMYMFPLLYALFQSAEAGIFVLIYKMYGSEMLHKRDPLDEDEDTDISYKKLKEEEMADTSYGTVKAENIIMMETAQTSL

SEQ ID NO: 63964 - protein, 377 aa, Homo sapiens
MRANCSSSSACPANSSEEELPVGLEVHGNLELVFTVVSTVMMGLLMFSLGCSVEIRKLWSHIRRPWGIAVGLLCQFGLMPFTAYLLAISFSLKPVQAIAVLIMGCCPGGTISNIFTFWVDGDMDLSISMTTCSTVAALGMMPLCIYLYTWSWSLQQNLTIPYQNIGITLVCLTIPVAFGVYVNYRWPKQSKIILKIGAVVGGVLLLVVAVAGVVLAKGSWNSDITLLTISFIFPLIGHVTGFLLALFTHQSWQRCRTISLETGAQNIQMCITMLQLSFTAEHLVQMLSFPLAYGLFQLIDGFLIVAAYQTYKRRLKNKHGKKNSGCTEVCHTRKSTSSRETNAFLEVNEEGAITPGPPGPMDCHRALEPVGHITSCE

SEQ ID NO: 63965 - protein, 550 aa, Homo sapiens
MTGDKGPQRLSGSSYGSISSPTSPTSPGPQQAPPRETYLSEKIPIPDTKPGTFSLRKLWAFTGPGFLMSIAFLDPGNIESDLQAGAVAGFKLLWVLLWATVLGLLCQRLAARLGVVTGKDLGEVCHLYYPKVPRTVLWLTIELAIVGSDMQEVIGTAIAFNLLSAGRIPLWGGVLITIVDTFFFLFLDNYGLRKLEAFFGLLITIMALTFGYEYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 63966 - protein, 163 aa, Homo sapiens
MTGDKGPQRLSGSSYGSISSPTSPTSPGPQQAPPRETYLSEKIPIPDTKPGTFSLRKLWAFTGPGFLMSIAFLDPGNIESDLQAGAVAGFKLLWVLLWATVLGLLCQRLAARLGVVTGKDLGEVCHLYYPKSESRSVAQSGVQWCDVSSLQPLPPRCPAPSSG

SEQ ID NO: 63967 - protein, 432 aa, Homo sapiens
MVRCQLTATSTSQVPRTVLWLTIELAIVGSDMQEVIGTAIAFNLLSAGRIPLWGGVLITIVDTFFFLFLDNYGLRKLEAFFGLLITIMALTFGYEYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 63968 - protein, 1116 aa, Homo sapiens
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLAYLFPAMAIFKAEDASGEAAAMLNNMRVYGTCVLTCMATVVFVGVKYVNKFALVFLGCVILSILAIYAGVIKSAFDPPNFPICLLGNRTLSRHGFDVCAKLAWEGNETVTTRLWGLFCSSRFLNATCDEYFTRNNVTEIQGIPGAASGLIKENLWSSYLTKGVIVERSGMTSVGLADGTPIDMDHPYVFSDMTSYFTLLVGIYFPSVTGIMAGSNRSGDLRDAQKSIPTGTILAIATTSAVYISSVVLFGACIEGVVLRDKFGEAVNGNLVVGTLAWPSPWVIVIGSFFSTCGAGLQSLTGAPRLLQAISRDGIVPFLQVFGHGKANGEPTWALLLTACICEIGILIASLDEVAPILSMFFLMCYMFVNLACAVQTLLRTPNWRPRFRYYHWTLSFLGMSLCLALMFICSWYYALVAMLIAGLIYKYIEYRGAEKEWGDGIRGLSLSAARYALLRLEEGPPHTKNWRPQLLVLVRVDQDQNVVHPQLLSLTSQLKAGKGLTIVGSVLEGTFLENHPQAQRAEESIRRLMEAEKVKGFCQVVISSNLRDGVSHLIQSGGLGGLQHNTVLVGWPRNWRQKEDHQTWRNFIELVRETTAGHLALLVTKNVSMFPGNPERFSEGSIDVWWIVHDGGMLMLLPFLLRHHKVWRKCKMRIFTVAQMDDNSIQMKKDLTTFLYHLRITAEVEVVEMHESDISAYTYEKTLVMEQRSQILKQMHLTKNEREREIQSITDESRGSIRRKNPANTRLRLNVPEETAGDSEEKPEEEVQLIHDQSAPSCPSSSPSPGEEPEGEGETDPEKVHLTWTKDKSVAEKNKGPSPVSSEGIKDFFSMKPEWENLNQSNVRRMHTAVRLNEVIVKKSRDAKLVLLNMPGPPRNRNGDENYMEFLEVLTEHLDRVMLVRGGGREVITIYS

SEQ ID NO: 63969 - protein, 285 aa, Homo sapiens
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLAYLFPAMAIFKAEDASGEAAAMLNNMRVYGTCVLTCMATVVFVGVKYVNKFALVFLGCVILSILAIYAGVIKSAFDPPNFP

SEQ ID NO: 63970 - protein, 1139 aa, Homo sapiens
MSRRFTVTSLPPAGPARSPDPESRRHSVADPRHLPGEDVKGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLAYLFPAMAIFKAEDASGEAAAMLNNMRVYGTCVLTCMATVVFVGVKYVNKFALVFLGCVILSILAIYAGVIKSAFDPPNFPICLLGNRTLSRHGFDVCAKLAWEGNETVTTRLWGLFCSSRFLNATCDEYFTRNNVTEIQGIPGAASGLIKENLWSSYLTKGVIVERSGMTSVGLADGTPIDMDHPYVFSDMTSYFTLLVGIYFPSVTGIMAGSNRSGDLRDAQKSIPTGTILAIATTSAVYISSVVLFGACIEGVVLRDKFGEAVNGNLVVGTLAWPSPWVIVIGSFFSTCGAGLQSLTGAPRLLQAISRDGIVPFLQVFGHGKANGEPTWALLLTACICEIGILIASLDEVAPILSMFFLMCYMFVNLACAVQTLLRTPNWRPRFRYYHWTLSFLGMSLCLALMFICSWYYALVAMLIAGLIYKYIEYRGAEKEWGDGIRGLSLSAARYALLRLEEGPPHTKNWRPQLLVLVRVDQDQNVVHPQLLSLTSQLKAGKGLTIVGSVLEGTFLENHPQAQRAEESIRRLMEAEKVKGFCQVVISSNLRDGVSHLIQSGGLGGLQHNTVLVGWPRNWRQKEDHQTWRNFIELVRETTAGHLALLVTKNVSMFPGNPERFSEGSIDVWWIVHDGGMLMLLPFLLRHHKVWRKCKMRIFTVAQMDDNSIQMKKDLTTFLYHLRITAEVEVVEMHESDISAYTYEKTLVMEQRSQILKQMHLTKNEREREIQSITDESRGSIRRKNPANTRLRLNVPEETAGDSEEKPEEEVQLIHDQSAPSCPSSSPSPGEEPEGEGETDPEKVHLTWTKDKSVAEKNKGPSPVSSEGIKDFFSMKPEWENLNQSNVRRMHTAVRLNEVIVKKSRDAKLVLLNMPGPPRNRNGDENYMEFLEVLTEHLDRVMLVRGGGREVITIYS

SEQ ID NO: 63971 - protein, 186 aa, Homo sapiens
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLAMARPMESRPGPCS

SEQ ID NO: 63972 - protein, 1085 aa, Homo sapiens
MPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 63973 - protein, 780 aa, Homo sapiens
MPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTPCAALRLPTWPCSCPRTSPSTPATTSATWRAT

SEQ ID NO: 63974 - protein, 1087 aa, Homo sapiens
MRAGGACRPGAAGTAAGTAAGGWDGGCGGAEPARCLTSPWCQWTGRGAATMTTSRGSVGWTTGSAPSWMTRTEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 63975 - protein, 1079 aa, Homo sapiens
MAAEGAVCGFVYLEGTAWAVPEDTEPLASCTLGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 63976 - protein, 1054 aa, Homo sapiens
MGDTLSPGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 63977 - protein, 1099 aa, Homo sapiens
MPHFTVTKVEDPEEGAAASISQEPSLADIKARIQDSDEPDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 63978 - protein, 1150 aa, Homo sapiens
MHPPETTTKMASVRFMVTPTKIDDIPGLSDTSPDLSSRSSSRVRFSSRESVPETSRSEPMSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 63979 - protein, 1091 aa, Homo sapiens
MSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 63980 - protein, 1135 aa, Homo sapiens
MHPPETTTKMASVRFMVTPTKIDDIPGLSDTSPDLSSRSSSRVRFSSRESVPETSRSEPMSEMSGATTSLATVALDPPSDRTSHPQDVIEDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 63981 - protein, 962 aa, Homo sapiens
MDTRPKVSSLLNRMANYTNLTQGAKEHEEAENITEGKKKPTKTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 63982 - protein, 1091 aa, Homo sapiens; identical to SEQ ID NO: 63979

SEQ ID NO: 63983 - protein, 1141 aa, Homo sapiens
MASVRFMVTPTKIDDIPGLSDTSPDLSSRSSSRVRFSSRESVPETSRSEPMSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 63984 - protein, 1150 aa, Homo sapiens; identical to SEQ ID NO: 63978

SEQ ID NO: 63985 - protein, 61 aa, Homo sapiens
MSEMSGATTSLATVALDPPSDRTSHPQDVIEDLSQNSITGEHSQLLDDGHKKARNAYLNNS

SEQ ID NO: 63986 - protein, 962 aa, Homo sapiens; identical to SEQ ID NO: 63981

SEQ ID NO: 63987 - protein, 1150 aa, Homo sapiens; identical to SEQ ID NO: 63978

SEQ ID NO: 63988 - protein, 152 aa, Homo sapiens
MASVRFMVTPTKIDDIPGLSDTSPDLSSRSSSRVRFSSRESVPETSRSEPMSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQ

SEQ ID NO: 63989 - protein, 1083 aa, Homo sapiens
MPTNFTVVPVEAHADGGGDETAERTEAPGTPEGPEPERPSPGDGNPRENSPFLNNVEVEQESFFEGKNMALFEEEMDSNPMVSSLLNKLANYTNLSQGVVEHEEDEESRRREAKAPRMGTFIGVYLPCLQNILGVILFLRLTWIVGVAGVLESFLIVAMCCTCTMLTAISMSAIATNGVVPAGGSYYMISRSLGPEFGGAVGLCFYLGTTFAGAMYILGTIEIFLTYISPGAAIFQAEAAGGEAAAMLHNMRVYGTCTLVLMALVVFVGVKYVNKLALVFLACVVLSILAIYAGVIKSAFDPPDIPVCLLGNRTLSRRSFDACVKAYGIHNNSATSALWGLFCNGSQPSAACDEYFIQNNVTEIQGIPGAASGVFLENLWSTYAHAGAFVEKKGVPSVPVAEESRASALPYVLTDIAASFTLLVGIYFPSVTGIMAGSNRSGDLKDAQKSIPTGTILAIVTTSFIYLSCIVLFGACIEGVVLRDKFGEALQGNLVIGMLAWPSPWVIVIGSFFSTCGAGLQSLTGAPRLLQAIARDGIVPFLQVFGHGKANGEPTWALLLTVLICETGILIASLDSVAPILSMFFLMCYLFVNLACAVQTLLRTPNWRPRFKFYHWTLSFLGMSLCLALMFICSWYYALSAMLIAGCIYKYIEYRGAEKEWGDGIRGLSLNAARYALLRVEHGPPHTKNWRPQVLVMLNLDAEQAVKHPRLLSFTSQLKAGKGLTIVGSVLEGTYLDKHMEAQRAEENIRSLMSTEKTKGFCQLVVSSSLRDGMSHLIQSAGLGGLKHNTVLMAWPASWKQEDNPFSWKNFVDTVRDTTAAHQALLVAKNVDSFPQNQERFGGGHIDVWWIVHDGGMLMLLPFLLRQHKVWRKCRMRIFTVAQVDDNSIQMKKDLQMFLYHLRISAEVEVVEMVENDISAFTYERTLMMEQRSQMLKQMQLSKNEQEREAQLIHDRNTASHTAAAARTQAPPTPDKVQMTWTREKLIAEKYRSRDTSLSGFKDLFSMKPDQSNVRRMHTAVKLNGVVLNKSQDAQLVLLNMPGPPKNRQGDENYMEFLEVLTEGLNRVLLVRGGGREVITIYS

SEQ ID NO: 63990 - protein, 266 aa, Homo sapiens
MPTNFTVVPVEAHADGGGDETAERTEAPGTPEGPEPERPSPGDGNPRENSPFLNNVEVEQESFFEGKNMALFEEEMDSNPMVSSLLNKLANYTNLSQGVVEHEEDEESRRREAKAPRMGTFIGVYLPCLQNILGVILFLRLTWIVGVAGVLESFLIVAMCCTCTMLTAISMSAIATNGVVPAGGSYYMISRSLGPEFGGAVGLCFYLGTTFAGAMYILGTIEIFLTGTEDGVGSLGLGLAQGNRRQTHLSPSDAAQAAHGASYGSF

SEQ ID NO: 63991 - protein, 1021 aa, Homo sapiens
MAELPTTETPGDATLCSGRFTISTLLSSDEPSPPAAYDSSHPSHLTHSSTFCMRTFGYNTIDVVPTYEHYANSTQPGEPRKVRPTLADLHSFLKQEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIAVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARVDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 63992 - protein, 1029 aa, Homo sapiens
MAELPTTETPGDATLCSGRFTISTLLSSDEPSPPAAYDSSHPSHLTHSSTFCMRTFGYNTIDVVPTYEHYANSTQPGEPRKVRPTLADLHSFLKEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIAVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARGARPSVSGALDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 63993 - protein, 1030 aa, Homo sapiens
MAELPTTETPGDATLCSGRFTISTLLSSDEPSPPAAYDSSHPSHLTHSSTFCMRTFGYNTIDVVPTYEHYANSTQPGEPRKVRPTLADLHSFLKQEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIAVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARGARPSVSGALDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 63994 - protein, 1029 aa, Homo sapiens; identical to SEQ ID NO: 63992

SEQ ID NO: 63995 - protein, 430 aa, Homo sapiens
MSLNNSSNVFLDSVPSNTNRFQVSVINENHESSAAADDNTDPPHYEETSFGDEAQKRLRISFRPGNQECYDNFLQSGETAKTDASFHAYDSHTNTYYLQTFGHNTMDAVPKIEYYRNTGSISGPKVNRPSLLEIHEQLAKNVAVTPSSADRVANGDGIPGDEQAENKEDDQAGVVKFGWVKGVLVRCMLNIWGVMLFIRLSWIVGEAGIGLGVLIILLSTMVTSITGLSTSAIATNGFVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEALRKQGASPLPQGAQSRRRRQTSLI

SEQ ID NO: 63996 - protein, 1099 aa, Homo sapiens
MSLNNSSNVFLDSVPSNTNRFQVSVINENHESSAAADDNTDPPHYEETSFGDEAQKRLRISFRPGNQECYDNFLQSGETAKTDASFHAYDSHTNTYYLQTFGHNTMDAVPKIEYYRNTGSISGPKVNRPSLLEIHEQLAKNVAVTPSSADRVANGDGIPGDEQAENKEDDQAGVVKFGWVKGVLVRCMLNIWGVMLFIRLSWIVGEAGIGLGVLIILLSTMVTSITGLSTSAIATNGFVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEDPQDAIPRGTMLAIFITTVAYLGVAICVGACVVRDATGNMNDTIISGMNCNGSAACGLGYDFSRCRHEPCQYGLMNNFQVMSMVSGFGPLITAGIFSATLSSALASLVSAPKVFQALCKDNIYKALQFFAKGYGKNNEPLRGYILTFLIAMAFILIAELNTIAPIISNFFLASYALINFSCFHASYAKSPGWRPAYGIYNMWVSLFGAVLCCAVMFVINWWAAVITYVIEFFLYVYVTCKKPDVNWGSSTQALSYVSALDNALELTTVEDHVKNFRPQCIVLTGGPMTRPALLDITHAFTKNSGLCICCEVFVGPRKLCVKEMNSGMAKKQAWLIKNKIKAFYAAVAADCFRDGVRSLLQASGLGRMKPNTLVIGYKKNWRKAPLTEIENYVGIIHDAFDFEIGVVIVRISQGFDISQVLQVQEELERLEQERLALEATIKDNECEEESGGIRGLFKKAGKLNITKTTPKKDGSINTSQSMHVGEFNQKLVEASTQFKKKQEKGTIDVWWLFDDGGLTLLIPYILTLRKKWKDCKLRIYVGGKINRIEEEKIVMASLLSKFRIKFADIHIIGDINIRPNKESWKVFEEMIEPYRLHESCKDLTTAEKLKRETPWKITDAELEAVKEKSYRQVRLNELLQEHSRAANLIVLSLPVARKGSISDLLYMAWLEILTKNLPPVLLVRGNHKNVLTFYS

SEQ ID NO: 63997 - protein, 1099 aa, Homo sapiens
MSLNNSSNVFLDSVPSNTNRFQVSVINENHESSAAADDNTDPPHYEETSFGDEAQKRLRISFRPGNQECYDNFLQSGETAKTDASFHAYDSHTNTYYLQTFGHNTMDAVPKIEYYRNTGSISGPKVNRPSLLEIHEQLAKNVAVTPSSADRVANGDGIPGDEQAENKEDDQAGVVKFGWVKGVLVRCMLNIWGVMLFIRLSWIVGEAGIGLGVIIIGLSVVVTTLTGISMSAICTNGVVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEDPQDAIPRGTMLAIFITTVAYLGVAICVGACVVRDATGNMNDTIISGMNCNGSAACGLGYDFSRCRHEPCQYGLMNNFQVMSMVSGFGPLITAGIFSATLSSALASLVSAPKVFQALCKDNIYKALQFFAKGYGKNNEPLRGYILTFLIAMAFILIAELNTIAPIISNFFLASYALINFSCFHASYAKSPGWRPAYGIYNMWVSLFGAVLCCAVMFVINWWAAVITYVIEFFLYVYVTCKKPDVNWGSSTQALSYVSALDNALELTTVEDHVKNFRPQCIVLTGGPMTRPALLDITHAFTKNSGLCICCEVFVGPRKLCVKEMNSGMAKKQAWLIKNKIKAFYAAVAADCFRDGVRSLLQASGLGRMKPNTLVIGYKKNWRKAPLTEIENYVGIIHDAFDFEIGVVIVRISQGFDISQVLQVQEELERLEQERLALEATIKDNECEEESGGIRGLFKKAGKLNITKTTPKKDGSINTSQSMHVGEFNQKLVEASTQFKKKQEKGTIDVWWLFDDGGLTLLIPYILTLRKKWKDCKLRIYVGGKINRIEEEKIVMASLLSKFRIKFADIHIIGDINIRPNKESWKVFEEMIEPYRLHESCKDLTTAEKLKRETPWKITDAELEAVKEKSYRQVRLNELLQEHSRAANLIVLSLPVARKGSISDLLYMAWLEILTKNLPPVLLVRGNHKNVLTFYS

SEQ ID NO: 63998 - protein, 593 aa, Homo sapiens
MLNIWGVMLFIRLSWIVGEAGIGLGVLIILLSTMVTSITGLSTSAIATNGFVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEDPQDAIPRGTMLAIFITTVAYLGVAICVGACVVRDATGNMNDTIISGMNCNGSAACGLGYDFSRCRHEPCQYGLMNNFQVMSMVSGFGPLITAGIFSATLSSALASLVSAPKVFQALCKDNIYKALQFFAKGYGKNNEPLRGYILTFLIAMAFILIAELNTIAPIISNFFLASYALINFSCFHASYAKSPGWRPAYGIYNMWVSLFGAVLCCAVMFVINWWAAVITYVIEFFLYVYVTCKKPDVNWGSSTQALSYVSALDNALELTTVEDHVKNFRPQCIVLTGGPMTRPALLDITHAFTKNSGLCICCEVFVGPRKLCVKEMNSGMAKTGLAYKEQNQGFLCCSGGRLFQGWCPKSSSGLRLRKNETKHSGDWI

SEQ ID NO: 63999 - protein, 179 aa, Homo sapiens
MRTMRAVQLQMTILTHHIMKKPLLGMKLRKDSESALGLGIRSAMTISSKQALSYVSALDNALELTTVEDHVKNFRPQCIVLTGGPMTRPALLDITHAFTKNSGLCICCEVFVGPRKLCVKEMNSGMAKKQAWLIKNKIKAFYAAVAADCFRDGVRSLLQASGLGRMKPNTLVIGYKKNW

SEQ ID NO: 64000 - protein, 1099 aa, Homo sapiens; identical to SEQ ID NO: 63996

SEQ ID NO: 64001 - protein, 648 aa, Homo sapiens
MLNIWGVMLFIRLSWIVGEAGIGLGVLIILLSTMVTSITGLSTSAIATNGFVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEDPQDAIPRGTMLAIFITTVAYLGVAICVGACVVRDATGNMNDTIISGMNCNGSAACGLGYDFSRCRHEPCQYGLMNNFQVMSMVSGFGPLITAGIFSATLSSALASLVSAPKVFQALCKDNIYKALQFFAKGYGKNNEPLRGYILTFLIAMAFILIAELNTIAPIISNFFLASYALINFSCFHASYAKSPGWRPAYGIYNMWVSLFGAVLCCAVMFVINWWAAVITYVIEFFLYVYVTCKKPDVNWGSSTQALSYVSALDNALELTTVEDHVKNFRPQCIVLTGGPMTRPALLDITHAFTKNSGLCICCEVFVGPRKLCVKEMNSGMAKKQAWLIKNKIKAFYAAVAADCFRDGVRSLLQASGLGRMKPNTLVIGYKKNWRKAPLTEIENYVGIIHDAFDFEIGVVIVRISQGFDISQVLQVQEELERLE

SEQ ID NO: 64002 - protein, 1212 aa, Homo sapiens
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKVEEEDGKTATQPLLKKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 64003 - protein, 1196 aa, Homo sapiens
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 64004 - protein, 595 aa, Homo sapiens
MKFFSYILVYRRFLFVVFTVLVLLPLPIVLHTKEAECAYTLFVVATFWLTEALPLSVTALLPSLMLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKNSGMRTKYRTKKGHVTRKLTCLCIAYSSTIGGLTTITGTSTNLIFAEYFNTRYPDCRCLNFGSWFTFSFPAALIILLLSWIWLQWLFLGFNFKEMFKCGKTKTVQQKACAEVIKQEYQKLGPIRYQEIVTLVLFIIMALLWFSRDPGFVPGWSALFSEYPGFATDSTVALLIGLLFFLIPAKTLTKTTPTGEIVAFDYSPLITWKEFQSFMPWDIAILVGGGFALADGCEESGLSKWIGNKLSPLGSLPAWLIILISSLMVTSLTEVASNPATITLFLPILSPLAEAIHVNPLYILIPSTLCTSFAFLLPVANPPNAIVFSYGHLKVIDMVKAGLGVNIVGVAVVMLGICTWIVPMFDLYTYPSWAPAMSNETMP

SEQ ID NO: 64005 - protein, 161 aa, Homo sapiens
MLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKYLQVR

SEQ ID NO: 64006 - protein, 626 aa, Homo sapiens
MGLLQGLLRVRKLLLVVCVPLLLLPLPVLHPSSEASCAYVLIVTAVYWVSEAVPLGAAALVPAFLYPFFGVLRSNEVAAEYFKNTTLLLVGVICVAAAVEKWNLHKRIALRMVLMAGAKPGMLLLCFMCCTTLLSMWLSNTSTTAMVMPIVEAVLQELVSAEDEQLVAGNSNTEEAEPISLDVKNSQPSLELIFVNEESNADLTTLMHNENLNGVPSITNPIKTANQHQGKKQHPSQEKPQVLTPSPRKQKLNRKYRSHHDQMICKCLSLSISYSATIGGLTTIIGTSTSLIFLEHFNNQYPAAEVVNFGTWFLFSFPISLIMLVVSWFWMHWLFLGCNFKETCSLSKKKKTKREQLSEKRIQEEYEKLGDISYPEMVTGFFFILMTVLWFTREPGFVPGWDSFFEKKGYRTDATVSVFLGFLLFLIPAKKPCFGKKNDGENQEHSLGTEPIITWKDFQKTMPWEIVILVGGGYALASGSKSSGLSTWIGNQMLSLSSLPPWAVTLLACILVSIVTEFVSNPATITIFLPILCSLSETLHINPLYTLIPVTMCISFAVMLPVGNPPNAIVFSYGHCQIKDMVKAGLGVNVIGLVIVMVAINTWGVSLFHLDTYPAWARVSNITDQA

SEQ ID NO: 64007 - protein, 522 aa, Homo sapiens
MASALSYVSKFKSFVILFVTPLLLLPLVILMPAKFVRCAYVIILMAIYWCTEVIPLAVTSLMPVLLFPLFQILDSRQVCVQYMKDTNMLFLGGLIVAVAVERWNLHKRIALRTLLWVGAKPARLMLGFMGVTALLSMWISNTATTAMMVPIVEAILQQMEATSAATEAGLELVDKGKAKELPGSQVIFEGPTLGQQEDQERKRLCKAMTLCICYAASIGGTATLTGTGPNVVLLGQMNELFPDSKDLVNFASWFAFAFPNMLVMLLFAWLWLQFVYMRFNFKKSWGCGLESKKNEKAALKVLQEEYRKLGPLSFAEINVLICFFLLVILWFSRDPGFMPGWLTVAWVEGETKYVSDATVAIFVATLLFIVPSQKPKFNFRSQTEEERKTPFYPPPLLDWKVTQEKVPWGIVLLLGGGFALAKGSEASGLSVWMGKQMEPLHAVPPAAITLILSLLVAVFTECTSNVATTTLFLPIFASMVKTGVIMNIIGVFCVFLAVNTWGRAIFDLDHFPDWANVTHIET

SEQ ID NO: 64008 - protein, 568 aa, Homo sapiens [sequence omitted]

SEQ ID NO: 64009 - protein, 525 aa, Homo sapiens
MASALSYVSKFKSFVILFVTPLLLLPLVILMPAKVCVQYMKDTNMLFLGGLIVAVAVERWNLHKRIALRTLLWVGAKPARLMLGFMGVTALLSMWISNTATTAMMVPIVEAILQQMEATSAATEAGLELVDKGKAKELPGSQVIFEGPTLGQQEDQERKRLCKAMTLCICYAASIGGTATLTGTGPNVVLLGQMNELFPDSKDLVNFASWFAFAFPNMLVMLLFAWLWLQFVYMRFNFKKSWGCGLESKKNEKAALKVLQEEYRKLGPLSFAEINVLICFFLLVILWFSRDPGFMPGWLTVAWVEGETKYVSDATVAIFVATLLFIVPSQKPKFNFRSQTEEERKTPFYPPPLLDWKVTQEKVPWGIVLLLGGGFALAKGSEASGLSVWMGKQMEPLHAVPPAAITLILSLLVAVFTECTSNVATTTLFLPIFASMSRSIGLNPLYIMLPCTLSASFAFMLPVATPPNAIVFTYGHLKVADMVKTGVIMNIIGVFCVFLAVNTWGRAIFDLDHFPDWANVTHIET

SEQ ID NO: 64010 - protein, 522 aa, Homo sapiens; identical to SEQ ID NO: 64007

SEQ ID NO: 64011 - protein, 592 aa, Homo sapiens
MATCWQALWAYRSYLIVFFVPILLLPLPILVPSKEAYCAYAIILMALFWCTEALPLAVTALFPLILFPMMGIVDASEVAVEYLKDSNLLFFGGLLVAIAVEHWNLHKRIALRVLLIVGVRPAPLILGFMLVTAFLSMWISNTATSAMMVPIAHAVLDQLHSSQASSNVEEGSNNPTFELQEPSPQKEVTKLDNGQALPVTSASSEGRAHLSQKHLHLTQCMSLCVCYSASIGGIATLTGTAPNLVLQGQINSLFPQNGNVVNFASWFSFAFPTMVILLLLAWLWLQILFLGFNFRKNFGIGEKMQEQQQAAYCVIQTEHRLLGPMTFAEKAISILFVILVLLWFTREPGFFLGWGNLAFPNAKGESMVSDGTVAIFIGIIMFIIPSKFPGLTQDPENPGKLKAPLGLLDWKTVNQKMPWNIVLLLGGGYALAKGSERSGLSEWLGNKLTPLQSVPAPAIAIILSLLVATFTECTSNVATTTIFLPILASMAQAICLHPLYVMLPCTLATSLAFMLPVATPPNAIVFSFGDLKVLDMARAGFLLNIIGVLIIALAINSWGIPLFSLHSFPSWAQSNTTAQCLPSLANTTTPSP

SEQ ID NO: 64012 - protein, 641 aa, Homo sapiens
MATCWQALWAYRSYLIVFFVPILLLPLPILVPSKEAYCAYAIILMALFWCTEALPLAVTALFPLILFPMMGIVDASEIIQRPFPSSFESPGECQSVGMSVTASHNLGGTVGDSRVFPPLSHVSTCQVAVEYLKDSNLLFFGGLLVAIAVEHWNLHKRIALRVLLIVGVRPAPLILGFMLVTAFLSMWISNTATSAMMVPIAHAVLDQLHSSQASSNVEEGSNNPTFELQEPSPQKEVTKLDNGQALPVTSASSEGRAHLSQKHLHLTQCMSLCVCYSASIGGIATLTGTAPNLVLQGQINSLFPQNGNVVNFASWFSFAFPTMVILLLLAWLWLQILFLGFNFRKNFGIGEKMQEQQQAAYCVIQTEHRLLGPMTFAEKAISILFVILVLLWFTREPGFFLGWGNLAFPNAKGESMVSDGTVAIFIGIIMFIIPSKFPGLTQDPENPGKLKAPLGLLDWKTVNQKMPWNIVLLLGGGYALAKGSERSGLSEWLGNKLTPLQSVPAPAIAIILSLLVATFTECTSNVATTTIFLPILASMAQAICLHPLYVMLPCTLATSLAFMLPVATPPNAIVFSFGDLKVLDMARAGFLLNIIGVLIIALAINSWGIPLFSLHSFPSWAQSNTTAQCLPSLANTTTPSP

SEQ ID NO: 64013 - protein, 521 aa, Homo sapiens
MPVCGNVAVEYLKDSNLLFFGGLLVAIAVEHWNLHKRIALRVLLIVGVRPAPLILGFMLVTAFLSMWISNTATSAMMVPIAHAVLDQLHSSQASSNVEEGSNNPTFELQEPSPQKEVTKLDNGQALPVTSASSEGRAHLSQKHLHLTQCMSLCVCYSASIGGIATLTGTAPNLVLQGQINSLFPQNGNVVNFASWFSFAFPTMVILLLLAWLWLQILFLGFNFRKNFGIGEKMQEQQQAAYCVIQTEHRLLGPMTFAEKAISILFVILVLLWFTREPGFFLGWGNLAFPNAKGESMVSDGTVAIFIGIIMFIIPSKFPGLTQDPENPGKLKAPLGLLDWKTVNQKMPWNIVLLLGGGYALAKGSERSGLSEWLGNKLTPLQSVPAPAIAIILSLLVATFTECTSNVATTTIFLPILASMAQAICLHPLYVMLPCTLATSLAFMLPVATPPNAIVFSFGDLKVLDMARAGFLLNIIGVLIIALAINSWGIPLFSLHSFPSWAQSNTTAQCLPSLANTTTPSP

SEQ ID NO: 64014 - protein, 344 aa, Homo sapiens
MALFWCTEALPLAVTALFPLILFPMMGIVDASEVAVEYLKDSNLLFFGGLLVAIAVEHWNLHKRIALRVLLIVGVRPAPLILGFMLVTAFLSMWISNTATSAMMVPIAHAVLDQLHSSQASSNVEEGSNNPTFELQEPSPQKEVTKLDNGQALPVTSASSEGRAHLSQKHLHLTQCMSLCVCYSASIGGIATLTGTAPNLVLQGQINSLFPQNGNVVNFASWFSFAFPTMVILLLLAWLWLQILFLGFNFRKNFGIGEKMQEQQQAAYCVIQTEHRLLGPMTFAEKAISILFVILVLLWFTREPGFFWLGQFGFSQCQGGEVRVAGVGRRTHLGLTCSGRREGY

SEQ ID NO: 64015 - protein, 549 aa, Homo sapiens
MATCWQALWAYRSYLIVFFVPILLLPLPILVPSKVAVEYLKDSNLLFFGGLLVAIAVEHWNLHKRIALRVLLIVGVRPAPLILGFMLVTAFLSMWISNTATSAMMVPIAHAVLDQLHSSQASSNVEEGSNNPTFELQEPSPQKEVTKLDNGQALPVTSASSEGRAHLSQKHLHLTQCMSLCVCYSASIGGIATLTGTAPNLVLQGQINSLFPQNGNVVNFASWFSFAFPTMVILLLLAWLWLQILFLGFNFRKNFGIGEKMQEQQQAAYCVIQTEHRLLGPMTFAEKAISILFVILVLLWFTREPGFFLGWGNLAFPNAKGESMVSDGTVAIFIGIIMFIIPSKFPGLTQDPENPGKLKAPLGLLDWKTVNQKMPWNIVLLLGGGYALAKGSERSGLSEWLGNKLTPLQSVPAPAIAIILSLLVATFTECTSNVATTTIFLPILASMAQAICLHPLYVMLPCTLATSLAFMLPVATPPNAIVFSFGDLKVLDMARAGFLLNIIGVLIIALAINSWGIPLFSLHSFPSWAQSNTTAQCLPSLANTTTPSP

SEQ ID NO: 64016 - protein, 602 aa, Homo sapiens
MAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 64017 - protein, 555 aa, Homo sapiens
MAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 64018 - protein, 232 aa, Homo sapiens
MAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTGIEPNTFLSEERLKLQAPLVIRLGQITESGQWNMSGNDVCNFRVLSFLPGGM

SEQ ID NO: 64019 - protein, 338 aa, Homo sapiens
MAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAKTTLGRQRFHWICRLTPGRRMNIVGTSGRASSSPSPTQPVLGAQPHSRAQPLTSSCLASSRGWLWISFLYGGLSFRGWRKNKSEIRTNAEDRARAVIREEYQNLGPIKFAEQAVFILFCMFAILLFTRDPKFIPGWASLFNPGCKMGIISISTIQKM

SEQ ID NO: 64020 - protein, 520 aa, Homo sapiens
MAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 64021 - protein, 552 aa, Homo sapiens
MAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAKTTLGRQRFHWICRLTPGRRMNIVGTSGRASSSPSPTQPVLGAQPHSRAQPLTSSCLASSRGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 64022 - protein, 185 aa, Homo sapiens
MAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTGIEPNTFLSEERLKLQAPLVIRLGQITESGQWNMSGNDVCNFRVLSFLPGGM

SEQ ID NO: 64023 - protein, 187 aa, Homo sapiens
MLSPAWLLSPSCSSSRPKGPLSSGGLTSKESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 64024 - protein, 409 aa, Homo sapiens
MAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQL

SEQ ID NO: 64025 - protein, 555 aa, Homo sapiens; identical to SEQ ID NO: 64017

SEQ ID NO: 64026 - protein, 920 aa, Homo sapiens
MSDPHSSPLLPEPLSSRYKLYEAEFTSPSWPSTSPDTHPALPLLEMPEEKDLRSSNEDSHIVKIEKLNERSKRKDDGVAHRDSAGQRCICLSKAVGYLTGDMKEYRIWLKDKHLALQFIDWVLRGTAQVMFINNPLSGLIIFIGLLIQNPWWTITGGLGTVVSTLTALALGQDRSAIASGLHGYNGMLVGLLMAVFSEKLDYYWWLLFPVTFTAMSCPVLSSALNSIFSKWDLPVFTLPFNIAVTLYLAATGHYNLFFPTTLVEPVSSVPNITWTEMEMPLLLQAIPVGVGQVYGCDNPWTGGVFLVALFISSPLICLHAAIGSIVGLLAALSVATPFETIYTGLWSYNCVLSCIAIGGMFYALTWQTHLLALICALFCAYMEAAISNIMSVVGVPPGTWAFCLATIIFLLLTTNNPAIFRLPLSKVTYPEANRIYYLTVKSGEEEKAPSGGGGEHPPTAGPKVEEGSEAVLSKHRSVFHIEWSSIRRRSKVFGKGEHQERQNKDPFPYRYRKPTVELLDLDTMEESSEIKVETNISKTSWIRSSMAASGKRVSKALSYITGEMKECGEGLKDKSPVFQFFDWVLRGTSQVMFVNNPLSGILIILGLFIQNPWWAISGCLGTIMSTLTALILSQDKSAIAAGFHGYNGVLVGLLMAVFSDKGDYYWWLLLPVIIMSMSCPILSSALGTIFSKWDLPVFTLPFNITVTLYLAATGHYNLFFPTTLLQPASAMPNITWSEVQVPLLLRAIPVGIGQVYGCDNPWTGGIFLIALFISSPLICLHAAIGSTMGMLAALTIATPFDSIYFGLCGFNSTLACIAIGGMFYVITWQTHLLAIACALFAAYLGAALANMLSVFGLPPCTWPFCLSALTFLLLTTNNPAIYKLPLSKVTYPEANRIYYLSQERNRRASIITKYQAYDVS

SEQ ID NO: 64027 - protein, 389 aa, Homo sapiens
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 64028 - protein, 284 aa, Homo sapiens
MALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 64029 - protein, 445 aa, Homo sapiens
MNGRSLIGGAGDARHGPVWKDPFGTKAGDAARRGIARLSLALADGSQEQEPEEEIAMEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 64030 - protein, 445 aa, Homo sapiens; identical to SEQ ID NO: 64029

SEQ ID NO: 64031 - protein, 214 aa, Homo sapiens
MNGRSLIGGAGDARHGPVWKDPFGTKAGDAARRGIARLSLALADGSQEQEPEEEIAMEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCC

SEQ ID NO: 64032 - protein, 281 aa, Homo sapiens
MGRRNRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 64033 - protein, 257 aa, Homo sapiens
MAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 64034 - protein, 920 aa, Homo sapiens; identical to SEQ ID NO: 64026

SEQ ID NO: 64035 - protein, 235 aa, Homo sapiens
MSDPHSSPLLPEPLSSRYKLYEAEFTSPSWPSTSPDTHPALPLLEMPEEKDLRSSNEDSHIVKIEKLNERSKRKDDGVAHRDSAGQRCICLSKAVGYLTGDMKEYRIWLKDKHLALQFIDWVLRGTAQVMFINNPLSGLIIFIGLLIQNPWWTITGGLGTVVSTLTALALGQDRSAIASGLHGYNGMLVGLLMAVFSEKLDYYWWLLFPVTFTAMSWMETDFNWSKSGCWKHLLQ

SEQ ID NO: 64036 - protein, 208 aa, Homo sapiens
MDQWGVYFNPVLVSFCQSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRGKRYLKGTSVGLF

SEQ ID NO: 64037 - protein, 282 aa, Homo sapiens
MRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRGKRYLKGTSVGLFLVRPSPCLLRFVLFFPSALFSSCQLHAGMHVGIWSKCFLPCEFHLLFVLFKSLIPVTTGESKPSLAWASIFLNCYSCKVMLVVRGKRQERCLGSQAGGRSCHFSLQALLPSDISVT

SEQ ID NO: 64038 - protein, 708 aa, Homo sapiens
MGMSKSHSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRVQQCGIHSKQACYPLAFGVPAALMAVALIVFVLGSGMYKKFKPQGNIMGKVAKCIGFAIKNRFRHRSKAFPKREHWLDWAKEKYDERLISQIKMVTRVMFLYIPLPMFWALFDQQGSRWTLQATTMSGKIGALEIQPDQMQTVNAILIVIMVPIFDAVLYPLIAKCGFNFTSLKKMAVGMVLASMAFVVAAIVQVEIDKTLPVFPKGNEVQIKVLNIGNNTMNISLPGEMVTLGPMSQTNAFMTFDVNKLTRINISSPGSPVTAVTDDFKQGQRHTLLVWAPNHYQVVKDGLNQKPEKGENGIRFVNTFNELITITMSGKVYANISSYNASTYQFFPSGIKGFTISSTEIPPQCQPNFNTFYLEFGSAYTYIVQRKNDSCPEVKVFEDISANTVNMALQIPQYFLLTCGEVVFSVTGLEFSYSQAPSNMKSVLQAGWLLTVAVGNIIVLIVAGAGQFSKQWAEYILFAALLLVVCVIFAIMARFYTYINPAEIEAQFDEDEKKNRLEKSNPYFMSGANSQKQM

SEQ ID NO: 64039 - protein, 500 aa, Homo sapiens
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLEKAGKSGVKKDLHDANTDLIGRHPKQEKRSVFQTINQFLDLTLFTHRGFLLYLSGNVIMFFGLFAPLVFLSSYGKSQHYSSEKSAFLLSILAFVDMVARPSMGLVANTKPIRPRIQYFFAASVVANGVCHMLAPLSTTYVGFCVYAGFFGFAFGWLSSVLFETLMDLVGPQRFSSAVGLVTIVECCPVLLGPPLLGRLNDMYGDYKYTYWACGVVLIISGIYLFIGMGINYRLLAKEQKANEQKKESKEEETSIDVAGKPNEVTKAAESPDQKDTDGGPKEEESPV

SEQ ID NO: 64040 - protein, 215 aa, Homo sapiens
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLE

SEQ ID NO: 64041 - protein, 430 aa, Homo sapiens
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLEKAGKSGVKKDLHDANTDLIGRHPKQEKRSVFQTINQFLDLTLFTHRGFLLYLSGNVIMFFGLFAPLVFLSSYGKSQHYSSEKSAFLLSILAFVDMVARPSMGLVANTKPIRPRIQYFFAASVVANGVCHMLAPLSTTYVGFCVYAGFFGFAFGWLSSVLFETLMDLVGPQRFSSAVGLVTIVECCPVLLGPPLLGIVYLPTNVGLLQNKHVRWEC

SEQ ID NO: 64042 - protein, 296 aa, Homo sapiens
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLEKAGKSGVKKDLHDANTDLIGRHPKQEKRSVFQTINQFLDLTLFTHRGFLLYLSGNVIMFFGLFAPLVFLSSYGKSQHYSSE

SEQ ID NO: 64043 - protein, 456 aa, Homo sapiens
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLEKAGKSGVKKDLHDANTDLIGRHPKQEKRSVFQTINQFLDLTLFTHRGFLLYLSGNVIMFFGLFAPLVFLSSYGKSQHYSSEKSAFLLSILAFVDMVARPSMGLVANTKPIRPRIQYFFAASVVANGVCHMLAPLSTTYVGFCVYAGFFGFAFGWLSSVLFETLMDLVGPQRFSSAVGLVTIVECCPVLLGPPLLGRLNDMYGDYKYTYWACGVVLIISGIYLFIGMGINYRLLAKEQKANE

SEQ ID NO: 64044 - protein, 500 aa, Homo sapiens; identical to SEQ ID NO: 64039

SEQ ID NO: 64045 - protein, 201 aa, Homo sapiens
MKHVNERFQDEKNKEVVLMCIGVTSGVGRLLFGRIADYVPGVKKVYLQVLSFFFIGLMSMMIPLCSIFGALIAVCLIMGLFDGCFISIMAPIAFELVGAQDVSQAIGFLLGFMSIPMTVGPPIAGLLRDKLGSYDVAFYLAGVPPLIGGAVLCFIPWIHSKKQREISKTTGKEKMEKMLENQNSLLSSSSGMFKKESDSII

SEQ ID NO: 64046 - protein, 515 aa, Homo sapiens
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLMKHVNERFQDEKNKEVVLMCIGVTSGVGRLLFGRIADYVPGVKKVYLQVLSFFFIGLMSMMIPLCSIFGALIAVCLIMGLFDGCFISIMAPIAFELVGAQDVSQAIGFLLGFMSIPMTVGPPIAGLLRDKLGSYDVAFYLAGVPPLIGGAVLCFIPWIHSKKQREISKTTGKEKMEKMLENQNSLLSSSSGMFKKESDSII

SEQ ID NO: 64047 - protein, 216 aa, Homo sapiens
MVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLAKFSFVILKYE

SEQ ID NO: 64048 - protein, 211 aa, Homo sapiens
  MOD_RES (1)..(1): Any amino acid
XWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLAKFSFVILKYE

SEQ ID NO: 64049 - protein, 206 aa, Homo sapiens
  MOD_RES (1)..(1): Any amino acid
XWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLVSMLLH

SEQ ID NO: 64050 - protein, 326 aa, Homo sapiens
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKNFQFCHLQGDSLCSVGSWNTTCTFWILCALCSLGEYAPSLIMNITI

SEQ ID NO: 64051 - protein, 486 aa, Homo sapiens
MAKVNRARSTSPPDGGWGWMIVAGCFLVTICTRAVTRCISIFFVEFQTYFTQDYAQTAWIHSIVDCVTMLCAPLGSVVSNHLSCQVGIMLGGLLASTGLILSSFATSLKHLYLTLGVLTGLGFALCYSPAIAMVGKYFSRRKALAYGIAMSGSGIGTFILAPVVQLLIEQFSWRGALLILGGFVLNLCVCGALMRPITLKEDHTTPEQNHVCRTQKEDIKRVSPYSSLTKEWAQTCLCCCLQQEYSFLLMSDFVVLAVSVLFMAYGCSPLFVYLVPYALSVGVSHQQAAFLMSILGVIDIIGNITFGWLTDRRCLKNYQYVCYLFAVGMDGLCYLCLPMLQSLPLLVPFSCTFGYFDGAYVTLIPVVTTEIVGTTSLSSALGVVYFLHAVPYLVSPPIAGRLVDTTGSYTAAFLLCGFSMIFSSVLLGFARLIKRMRKTQLQFIAKESDPKLQLWTNGSVAYSVARELDQKHGEPVATAVPGYSLT

SEQ ID NO: 64052 - protein, 516 aa, Homo sapiens
MPSGSHWTANSSKIITWLLEQPGKEEKRKTMAKVNRARSTSPPDGGWGWMIVAGCFLVTICTRAVTRCISIFFVEFQTYFTQDYAQTAWIHSIVDCVTMLCAPLGSVVSNHLSCQVGIMLGGLLASTGLILSSFATSLKHLYLTLGVLTGLGFALCYSPAIAMVGKYFSRRKALAYGIAMSGSGIGTFILAPVVQLLIEQFSWRGALLILGGFVLNLCVCGALMRPITLKEDHTTPEQNHVCRTQKEDIKRVSPYSSLTKEWAQTCLCCCLQQEYSFLLMSDFVVLAVSVLFMAYGCSPLFVYLVPYALSVGVSHQQAAFLMSILGVIDIIGNITFGWLTDRRCLKNYQYVCYLFAVGMDGLCYLCLPMLQSLPLLVPFSCTFGYFDGAYVTLIPVVTTEIVGTTSLSSALGVVYFLHAVPYLVSPPIAGRLVDTTGSYTAAFLLCGFSMIFSSVLLGFARLIKRMRKTQLQFIAKESDPKLQLWTNGSVAYSVARELDQKHGEPVATAVPGYSLT

SEQ ID NO: 64053 - protein, 25 aa, Homo sapiens
MPSGSHWTANSSKIITWLLEQPGKE

SEQ ID NO: 64054 - protein, 150 aa, Homo sapiens
MRPITLKEDHTTPEQNHVCRTQKEDIKRVSPYSSLTKEWAQTCLCCCLQQEYSFLLMSDFVVLAVSVLFMAYGCSPLFVYLVPYALSVGVSHQQAAFLMSILGVIDIIGNITFGWLTDRRFCIKTFGIFRKSVRKMYILRSTILHFYTEF

SEQ ID NO: 64055 - protein, 613 aa, Homo sapiens
MGRGGGGLDVGGGGEGSRDRLSRDGLASWGAEPGGGGSGSGSSSPPSSSSCSSRNKYQPQSGSSGPSSHSPPAAMALQSQASEEAKGPWQEADQEQQEPVGSPEPESEPEPEPEPEPVPVPPPEPQPEPQPLPDPAPLPELEFESERVHEPEPTPTVETRGTARGFQPPEGGFGWVVVFAATWCNGSIFGIHNSVGILYSMLLEEEKEKNRQVEFQAAWVGALAMGMIFFCSPIVSIFTDRLGCRITATAGAAVAFIGLHTSSFTSSLSLRYFTYGILFGCGCSFAFQPSLVILGHYFQRRLGLANGVVSAGSSIFSMSFPFLIRMLGDKIKLAQTFQVLSTFMFVLMLLSLTYRPLLPSSQDTPSKRGVRTLHQRFLAQLRKYFNMRVFRQRTYRIWAFGIAAAALGYFVPYVHLMKYVEEEFSEIKETWVLLVCIGATSGLGRLVSGHISDSIPGLKKIYLQVLSFLLLGLMSMMIPLCRDFGGLIVVCLFLGLCDGFFITIMAPIAFELVGPMQASQAIGYLLGMMALPMIAGPPIAGLLRNCFGDYHVAFYFAGVPPIIGAVILFFVPLMHQRMFKKEQRDSSKDKMLAPDPDPNGELLPGSPNPEEPI

SEQ ID NO: 64056 - protein, 478 aa, Homo sapiens
MPPMPSAPPVHPPPDGGWGWIVVGAAFISIGFSYAFPKAVTVFFKEIQQIFHTTYSEIAWISSIMLAVMYAGGPVSSVLVNKYGSRPVVIAGGLLCCLGMVLASFSSSVVQLYLTMGFITGLGLAFNLQPALTIIGKYFYRKRPMANGLAMAGSPVFLSSLAPFNQYLFNTFGWKGSFLILGSLLLNACVAGSLMRPLGPNQTTSKSKNKTGKTEDDSSPKKIKTKKSTWEKVNKYLDFSLFKHRGFLIYLSGNVIMFLGFFAPIIFLAPYAKDQGIDEYSAAFLLSVMAFVDMFARPSVGLIANSKYIRPRIQYFFSFAIMFNGVCHLLCPLAQDYTSLVLYAVFFGLGFGSVSSVLFETLMDLVGAPRFSSAVGLVTIVECGPVLLGPPLAGKLVDLTGEYKYMYMSCGAIVVAASVWLLIGNAINYRLLAKERKEENARQKTRESEPLSKSKHSEDVNVKVSNAQSVTSERETNI

SEQ ID NO: 64057 - protein, 379 aa, Homo sapiens
MVLASFSSSVVQLYLTMGFITGLGLAFNLQPALTIIGKYFYRKRPMANGLAMAGSPVFLSSLAPFNQYLFNTFGWKGSFLILGSLLLNACVAGSLMRPLGPNQTTSKSKNKTGKTEDDSSPKKIKTKKSTWEKVNKYLDFSLFKHRGFLIYLSGNVIMFLGFFAPIIFLAPYAKDQGIDEYSAAFLLSVMAFVDMFARPSVGLIANSKYIRPRIQYFFSFAIMFNGVCHLLCPLAQDYTSLVLYAVFFGLGFGSVSSVLFETLMDLVGAPRFSSAVGLVTIVECGPVLLGPPLAGKLVDLTGEYKYMYMSCGAIVVAASVWLLIGNAINYRLLAKERKEENARQKTRESEPLSKSKHSEDVNVKVSNAQSVTSERETNI

SEQ ID NO: 64058 - protein, 478 aa, Homo sapiens; identical to SEQ ID NO: 64056

SEQ ID NO: 64059 - protein, 478 aa, Homo sapiens; identical to SEQ ID NO: 64056

SEQ ID NO: 64060 - protein, 478 aa, Homo sapiens; identical to SEQ ID NO: 64056

SEQ ID NO: 64061 - protein, 509 aa, Homo sapiens
MELKKSPDGGWGWVIVFVSFLTQFLCYGSPLAVGVLYIEWLDAFGEGKGKTAWVGSLASGVGLLASPVCSLCVSSFGARPVTIFSGFMVAGGLMLSSFAPNIYFLFFSYGIVVGLGCGLLYTATVTITCQYFDDRRGLALGLISTGSSVGLFIYAALQRMLVEFYGLDGCLLIVGALALNILACGSLMRPLQSSDCPLPKKIAPEDLPDKYSIYNEKGKNLEENINILDKSYSSEEKCRITLANGDWKQDSLLHKNPTVTHTKEPETYKKKVAEQTYFCKQLAKRKWQLYKNYCGETVALFKNKVFSALFIAILLFDIGGFPPSLLMEDVARSSNVKEEEFIMPLISIIGIMTAVGKLLLGILADFKWINTLYLYVATLIIMGLALCAIPFAKSYVTLALLSGILGFLTGNWSIFPYVTTKTVGIEKLAHAYGILMFFAGLGNSLGPPIVGWFYDWTQTYDIAFYFSGFCVLLGGFILLLAALPSWDTCNKQLPKPAPTTFLYKVASNV

SEQ ID NO: 64062 - protein, 509 aa, Homo sapiens; identical to SEQ ID NO: 64061

SEQ ID NO: 64063 - protein, 65 aa, Homo sapiens
MELKKSPDGGWGWVIVFVSFLTQFLCYGSPLAVGVLYIEWLDAFGEGKGKTAWVGSLASGVGLLA

SEQ ID NO: 64064 - protein, 495 aa, Homo sapiens
MRSPVRDLARNDGEESTDRTPLLPGAPRAEAAPVCCSARYNLAILAFFGFFIVYALRVNLSVALVDMVDSNTTLEDNRTSKACPEHSAPIKVHHNQTGKKYQWDAETQGWILGSFFYGYIITQIPGGYVASKIGGKMLLGFGILGTAVLTLFTPIAADLGVGPLIVLRALEGLGEGVTFPAMHAMWSSWAPPLERSKLLSISYAGAQLGTVISLPLSGIICYYMNWTYVFYFFGTIGIFWFLLWIWLVSDTPQKHKRISHYEKEYILSSLRNQLSSQKSVPWVPILKSLPLWAIVVAHFSYNWTFYTLLTLLPTYMKEILRFNVQENGFLSSLPYLGSWLCMILSGQAADNLRAKWNFSTLCVRRIFSLIGMIGPAVFLVAAGFIGCDYSLAVAFLTISTTLGGFCSSGFSINHLDIAPSYAGILLGITNTFATIPGMVGPVIAKSLTPDNTVGEWQTVFYIAAAINVFGAIFFTLFAKGEVQNWALNDHHGHRH

SEQ ID NO: 64065 - protein, 181 aa, Homo sapiens
MRSPVRDLARNDGEESTDRTPLLPGAPRAEAAPVCCSARYNLAILAFFGFFIVYALRVNLSVALVDMVDSNTTLEDNRTSKACPEHSAPIKVHHNQTGKKYQWDAETQGWILGSFFYGYIITQIPGGYVASKIGGKMLLGFGILGTAVLTLFTPIAADLGVGPLIVLRALEGLGEEHSLGQ

SEQ ID NO: 64066 - protein, 467 aa, Homo sapiens
MQMDNRLPPKKVPGFCSFRYGLSFLVHCCNVIITAQRACLNLTMVVMVNSTDPHGLPNTSTKKLLDNIKNPMYNWSPDIQGIILSSTSYGVIIIQVPVGYFSGIYSTKKMIGFALCLSSVLSLLIPPAAGIGVAWVVVCRAVQGAAQGIVATAQFEIYVKWAPPLERGRLTSMSTSGFLLGPFIVLLVTGVICESLGWPMVFYIFGACGCAVCLLWFVLFYDDPKDHPCISISEKEYITSSLVQQVSSSRQSLPIKAILKSLPVWAISTGSFTFFWSHNIMTLYTPMFINSMLHVNIKENGFLSSLPYLFAWICGNLAGQLSDFFLTRNILSVIAVRKLFTAAGFLLPAIFGVCLPYLSSTFYSIVIFLILAGATGSFCLGGVFINGLDIAPRYFGFIKACSTLTGMIGGLIASTLTGLILKQDPESAWFKTFILMAAINVTGLIFYLIVATAEIQDWAKEKQHTRL

SEQ ID NO: 64067 - protein, 209 aa, Homo sapiens
MQMDNRLPPKKVPGFCSFRYGLSFLVHCCNVIITAQRACLNLTMVVMVNSTDPHGLPNTSTKKLLDNIKNPMYNWSPDIQGIILSSTSYGVIIIQVPVGYFSGIYSTKKMIGFALCLSSVLSLLIPPAAGIGVAWVVVCRAVQGAAQGIVATAQFEIYVKWAPPLERGRLTSMSTSGFLLGPFIVLLVTGVICESLGWPMVFYIFGQFK

SEQ ID NO: 64068 - protein, 413 aa, Homo sapiens
MQMDNRLPPKKVPGFCSFRYGLSFLVHCCNVIITAQRACLNLTMVVMVNSTDPHGLPNTSTKKLLDNIKNPMYNWSPDIQGIILSSTSYGVIIIQVPVGYFSGIYSTKKMIGFALCLSSVLSLLIPPAAGIGVAWVVVCRAVQGAAQGIVATAQFEIYVKWAPPLERGRLTSMSTSGFLLGPFIVLLVTGVICESLGWPMVFYIFGACGCAVCLLWFVLFYDDPKDHPCISISEKEYITSSLVQQNGFLSSLPYLFAWICGNLAGQLSDFFLTRNILSVIAVRKLFTAAGFLLPAIFGVCLPYLSSTFYSIVIFLILAGATGSFCLGGVFINGLDIAPRYFGFIKACSTLTGMIGGLIASTLTGLILKQDPESAWFKTFILMAAINVTGLIFYLIVATAEIQDWAKEKQHTRL

SEQ ID NO: 64069 - protein, 413 aa, Homo sapiens; identical to SEQ ID NO: 64068

SEQ ID NO: 64070 - protein, 467 aa, Homo sapiens; identical to SEQ ID NO: 64066

SEQ ID NO: 64071 - protein, 439 aa, Homo sapiens
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLGLLLPSICAVALPFVASSYVITIILLILIPGTSNLCDSGFIINTLDIAPRYASFLMGISRGFGLIAGIISSTATGFLISQVGPVY

SEQ ID NO: 64072 - protein, 436 aa, Homo sapiens
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLDMQVSSWESQGDLGSSQESSLPLPLDSSSVRILSLVGGMSFSCLLQSTCLAWSFTSRLDKQNFKTGPKRGPLPASEDIKLQT

SEQ ID NO: 64073 - protein, 478 aa, Homo sapiens
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLGLLLPSICAVALPFVASSYVITIILLILIPGTSNLCDSGFIINTLDIAPRYASFLMGISRGFGLIAGIISSTATGFLISQDFESGWRNVFFLSAAVNMFGLVFYLTFGQAELQDWAKERTLTRL

SEQ ID NO: 64074 - protein, 420 aa, Homo sapiens
MATKTELSPTARESKNAQDMQVDETLIPRKVPSLCSARYGIALVLHFCNFTTIAQNVIMNITMVAMVNSTSPQSQLNDSSEVLPVDSFGGLSKAPKSLPAKSSILGGQFAIWEKWGPPQERSRLCSIALSGMLLGCFTAILIGGFISETLGWPFVFYIFGGVGCVCCLLWFVVIYDDPVSYPWISTSEKEYIISSLKQQVGSSKQPLPIKAMLRSLPIWSICLGCFSHQWLVSTMVVYIPTYISSVYHVNIRDNGLLSALPFIVAWVIGMVGGYLADFLLTKKFRLITVRKIATILGSLPSSALIVSLPYLNSGYITATALLTLSCGLSTLCQSGIYINVLDIAPRYSSFLMGASRGFSSIAPVIVPTVSGFLLSQDPEFGWRNVFFLLFAVNLLGLLFYLIFGEADVQEWAKERKLTRL

SEQ ID NO: 64075 - protein, 420 aa, Homo sapiens; identical to SEQ ID NO: 64074

SEQ ID NO: 64076 - protein, 498 aa, Homo sapiens
MATKTELSPTARESKNAQDMQVDETLIPRKVPSLCSARYGIALVLHFCNFTTIAQNVIMNITMVAMVNSTSPQSQLNDSSEVLPVDSFGGLSKAPKSLPAKAPVYDWSPQIQGIIFGAVGYGGILTMAPSGYLAGRVGTKRVVGISLFATSFLTLCIPLATDFGIVLLIVTRIVQGLSQSSILGGQFAIWEKWGPPQERSRLCSIALSGMLLGCFTAILIGGFISETLGWPFVFYIFGGVGCVCCLLWFVVIYDDPVSYPWISTSEKEYIISSLKQQVGSSKQPLPIKAMLRSLPIWSICLGCFSHQWLVSTMVVYIPTYISSVYHVNIRDNGLLSALPFIVAWVIGMVGGYLADFLLTKKFRLITVRKIATILGSLPSSALIVSLPYLNSGYITATALLTLSCGLSTLCQSGIYINVLDIAPRYSSFLMGASRGFSSIAPVIVPTVSGFLLSQDPEFGWRNVFFLLFAVNLLGLLFYLIFGEADVQEWAKERKLTRL

SEQ ID NO: 64077 - protein, 99 aa, Homo sapiens
  MOD_RES (1)..(1): Any amino acid
XTLSCGLSTLCQSGIYINVLDIAPRYSSFLMGASRGFSSIAPVIVPTVSGFLLSQDPEFGWRNVFFLLFAVNLLGLLFYLIFGEADVQEWAKERKLTRL

SEQ ID NO: 64078 - protein, 51 aa, Homo sapiens
SGFLLSQDPEFGWRNVFFLLFAVNLLGLLFYLIFGEADVQEWAKERKLTRL

SEQ ID NO: 64079 - protein, 497 aa, Homo sapiens
MSTGPDVKATVGDISSDGNLNVAQEECSRKGFCSVRHGLALILQLCNFSIYTQQMNLSIAIPAMVNNTAPPSQPNASTERPSTDSQGYWNETLKEFKAMAPAYDWSPEIQGIILSSLNYGSFLAPIPSGYVAGIFGAKYVVGAGLFISSFLTLFIPLAANAGVALLIVLRIVQGIAQVMVLTGQYSIWVKWAPPLERSQLTTIAGSGSMLGSFIVLLAGGLLCQTIGWPYVFYIFGGIGCACCPLWFPLIYDDPVNHPFISAGEKRYIVCSLAQQDCSPGWSLPIRAMIKSLPLWAILVSYFCEYWLFYTIMAYTPTYISSVLQANLRDSGILSALPFVVGCICIILGGLLADFLLSRKILRLITIRKLFTAIGVLFPSVILVSLPWVRSSHSMTMTFLVLSSAISSFCESGALVNFLDIAPRYTGFLKGLLQVFAHIAGAISPTAAGFFISQDSEFGWRNVFLLSAAVNISGLVFYLIFGRADVQDWAKEQTFTHL

SEQ ID NO: 64080 - protein, 221 aa, Homo sapiens
MNLSIAIPAMVNNTAPPSQPNASTERPSTDSQGYWNETLKEFKAMDCSPGWSLPIRAMIKSLPLWAILVSYFCEYWLFYTIMAYTPTYISSVLQANLRDSGILSALPFVVGCICIILGGLLADFLLSRKILRLITIRKLFTAIGKGETGHRGERGKLRAAFSLLCVCPPTPGVLFPSVILVSLPWVRSSHSMTMTFLVLSSAISSFCESGALVNFLDIAPR

SEQ ID NO: 64081 - protein, 267 aa, Homo sapiens
MSTGPDVKATVGDISSDGNLNVAQEECSRKGFCSVRHGLALILQLCNFSIYTQQMNLSIAIPAMVNNTAPPSQPNASTERPSTDSQGYWNETLKEFKAMSGILSALPFVVGCICIILGGLLADFLLSRKILRLITIRKLFTAIGVLFPSVILVSLPWVRSSHSMTMTFLVLSSAISSFCESGALVNFLDIAPRYTGFLKGLLQVFAHIAGAISPTAAGFFISQDSEFGWRNVFLLSAAVNISGLVFYLIFGRADVQDWAKEQTFTHL

SEQ ID NO: 64082 - protein, 582 aa, Homo sapiens
MESVKQRILAPGKEGLKNFAGKSLGQIYRVLEKKQDTGETIELTEDGKPLEVPERKAPLCDCTCFGLPRRYIIAIMSGLGFCISFGIRCNLGVAIVDMVNNSTIHRGGKVIKEKAKFNWDPETVGMIHGSFFWGYIITQIPGGYIASRLAANRVFGAAILLTSTLNMLIPSAARVHYGCVIFVRILQGLVEGVTYPACHGIWSKWAPPLERSRLATTSFCGSYAGAVIAMPLAGILVQYTGWSSVFYVYGSFGMVWYMFWLLVSYESPAKHPTITDEERRYIEESIGESANLLGAMEKFKTPWRKFFTSMPVYAIIVANFCRSWTFYLLLISQPAYFEEVFGFEISKVGMLSAVPHLVMTIIVPIGGQIADFLRSKQILSTTTVRKIMNCGGFGMEATLLLVVGYSHTRGVAISFLVLAVGFSGFAISGFNVNHLDIAPRYASILMGISNGVGTLSGMVCPIIVGAMTKNKSREEWQYVFLIAALVHYGGVIFYAIFASGEKQPWADPEETSEEKCGFIHEDELDEETGDITQNYINYGTTKSYGATTQANGGWPSGWEKKEEFVQGEVQDSHSYKDRVDYS

SEQ ID NO: 64083 - protein, 470 aa, Homo sapiens [sequence omitted]

SEQ ID NO: 64084 - protein, 560 aa, Homo sapiens
MEFRQEEFRKLAGRALGKLHRLLEKRQEGAETLELSADGRPVTTQTRDPPVVDCTCFGLPRRYIIAIMSGLGFCISFGIRCNLGVAIVSMVNNSTTHRGGHVVVQKAQFSWDPETVGLIHGSFFWGYIVTQIPGGFICQKFAANRVFGFAIVATSTLNMLIPSAARVHYGCVIFVRILQGLVEGVTYPACHGIWSKWAPPLERSRLATTAFCGSYAGAVVAMPLAGVLVQYSGWSSVFYVYGSFGIFWYLFWLLVSYESPALHPSISEEERKYIEDAIGESAKLMNPLTKFSTPWRRFFTSMPVYAIIVANFCRSWTFYLLLISQPAYFEEVFGFEISKVGLVSALPHLVMTIIVPIGGQIADFLRSRRIMSTTNVRKLMNCGGFGMEATLLLVVGYSHSKGVAISFLVLAVGFSGFAISGFNVNHLDIAPRYASILMGISNGVGTLSGMVCPIIVGAMTKHKTREEWQYVFLIASLVHYGGVIFYGVFASGEKQPWAEPEEMSEEKCGFVGHDQLAGSDDSEMEDEAEPPGAPPAPPPSYGATHSTFQPPRPPPPVRDY

SEQ ID NO: 64085 - protein, 548 aa, Homo sapiens
MGSQLALAGLLEKRQEGAETLELSADGRPVTTQTRDPPVVDCTCFGLPRRYIIAIMSGLGFCISFGIRCNLGVAIVSMVNNSTTHRGGHVVVQKAQFSWDPETVGLIHGSFFWGYIVTQIPGGFICQKFAANRVFGFAIVATSTLNMLIPSAARVHYGCVIFVRILQGLVEGVTYPACHGIWSKWAPPLERSRLATTAFCGSYAGAVVAMPLAGVLVQYSGWSSVFYVYGSFGIFWYLFWLLVSYESPALHPSISEEERKYIEDAIGESAKLMNPLTKFSTPWRRFFTSMPVYAIIVANFCRSWTFYLLLISQPAYFEEVFGFEISKVGLVSALPHLVMTIIVPIGGQIADFLRSRRIMSTTNVRKLMNCGGFGMEATLLLVVGYSHSKGVAISFLVLAVGFSGFAISGFNVNHLDIAPRYASILMGISNGVGTLSGMVCPIIVGAMTKHKTREEWQYVFLIASLVHYGGVIFYGVFASGEKQPWAEPEEMSEEKCGFVGHDQLAGSDDSEMEDEAEPPGAPPAPPPSYGATHSTFQPPRPPPPVRDY

SEQ ID NO: 64086 - protein, 589 aa, Homo sapiens
MPFKAFDTFKEKILKPGKEGVKNAVGDSLGILQRKIDGTTEEEDNIELNEEGRPVQTSRPSPPLCDCHCCGLPKRYIIAIMSGLGFCISFGIRCNLGVAIVEMVNNSTVYVDGKPEIQTAQFNWDPETVGLIHGSFFWGYIMTQIPGGFISNKFAANRVFGAAIFLTSTLNMFIPSAARVHYGCVMCVRILQGLVEGVTYPACHGMWSKWAPPLERSRLATTSFCGSYAGAVVAMPLAGVLVQYIGWSSVFYIYGMFGIIWYMFWLLQAYECPAAHPTISNEEKTYIETSIGEGANVVSLSKFSTPWKRFFTSLPVYAIIVANFCRSWTFYLLLISQPAYFEEVFGFAISKVGLLSAVPHMVMTIVVPIGGQLADYLRSRQILTTTAVRKIMNCGGFGMEATLLLVVGFSHTKGVAISFLVLAVGFSGFAISGFNVNHLDIAPRYASILMGISNGVGTLSGMVCPLIVGAMTRHKTREEWQNVFLIAALVHYSGVIFYGVFASGEKQEWADPENLSEEKCGIIDQDELAEEIELNHESFASPKKKMSYGATSQNCEVQKKEWKGQRGATLDEEELTSYQNEERNFSTIS

SEQ ID NO: 64087 - protein, 539 aa, Homo sapiens
MPFKAFDTFKEKILKPGKEGVKNAVGDSLGILQRKIDGTTEEEDNIELNEEGRPVQTSRPSPPLCDCHCCGLPKRYIIAIMSGLGFCISFGIRCNLGVAIVEMVNNSTVYVDGKPEIQTAQFNWDPETVGLIHGSFFWGYIMTQIPGGFISNKFAANRVFGAAIFLTSTLNMFIPSAARVHYGCVMCVRILQGLVEGVTYPACHGMWSKWAPPLERSRLATTSFCGSYAGAVVAMPLAGVLVQYIGWSSVFYIYGMFGIIWYMFWLLQAYECPAAHPTISNEEKTYIETSIGEGANVVSLSVGLLSAVPHMVMTIVVPIGGQLADYLRSRQILTTTAVRKIMNCGGFGMEATLLLVVGFSHTKGVAISFLVLAVGFSGFAISGFNVNHLDIAPRYASILMGISNGVGTLSGMVCPLIVGAMTRHKTREEWQNVFLIAALVHYSGVIFYGVFASGEKQEWADPENLSEEKCGIIDQDELAEEIELNHESFASPKKKMSYGATSQNCEVQKKEWKGQRGATLDEEELTSYQNEERNFSTIS

SEQ ID NO: 64088 - protein, 430 aa, Homo sapiens
MTLTSRRQDSQEARPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQGVYFPALTSLLSQKVRESERAFTYSIVGAGSQFGTLLTGAVGSLLLEWYGWQSIFYFSGGLTLLWVWYVYRYLLSEKDLILALGVLAQSRPVSRHNRVPWRRLFRKPAVWAAVVSQLSAACSFFILLSWLPTFFEETFPDAKGWIFNVVPWLVAIPASLFSGFLSDHLINQGYRAITVRKLMQGMGLGLSSVFALCLGHTSSFCESVVFASASIGLQTFNHSGISVNIQDLAPSCAGFLFGVANTAGALAGVVGVCLGGYLMETTGSWTCLFNLVAIISNLGLCTFLVFGQAQRVDLSSTHEDL

SEQ ID NO: 64089 - protein, 436 aa, Homo sapiens
MQPPPDEARRDMAGDTQWSRPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQGVYFPALTSLLSQKVRESERAFTYSIVGAGSQFGTLLTGAVGSLLLEWYGWQSIFYFSGGLTLLWVWYVYRYLLSEKDLILALGVLAQSRPVSRHNRVPWRRLFRKPAVWAAVVSQLSAACSFFILLSWLPTFFEETFPDAKGWIFNVVPWLVAIPASLFSGFLSDHLINQGYRAITVRKLMQGMGLGLSSVFALCLGHTSSFCESVVFASASIGLQTFNHSGISVNIQDLAPSCAGFLFGVANTAGALAGVVGVCLGGYLMETTGSWTCLFNLVAIISNLGLCTFLVFGQAQRVDLSSTHEDL

SEQ ID NO: 64090 - protein, 152 aa, Homo sapiens
MFPRPGALSWTVRRHTPRQVEPPCVCMTLTSRRQDSQEARPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQ

SEQ ID NO: 64091 - protein, 532 aa, Homo sapiens
MESAEPAGQARAAATKLSEAVGAALQEPRRQRRLVLVIVCVALLLDNMLYMVIVPIVPDYIAHMRGGGEGPTRTPEVWEPTLPLPTPANASAYTANTSASPTAAWPAGSALRPRYPTESEDVKIGVLFASKAILQLLVNPLSGPFIDRMSYDVPLLIGLGVMFASTVLFAFAEDYATLFAARSLQGLGSAFADTSGIAMIADKYPEEPERSRALGVALAFISFGSLVAPPFGGILYEFAGKRVPFLVLAAVSLFDALLLLAVAKPFSAAARARANLPVGTPIHRLMLDPYIAVVAGALTTCNIPLAFLEPTIATWMKHTMAASEWEMGMAWLPAFVPHVLGVYLTVRLAARYPHLQWLYGALGLAVIGASSCIVPACRSFAPLVVSLCGLCFGIALVDTALLPTLAFLVDVRHVSVYGSVYAIADISYSVAYALGPIVAGHIVHSLGFEQLSLGMGLANLLYAPVLLLLRNVGLLTRSRSERDVLLDEPPQGLYDAVRLRERPVSGQDGEPRSPPGPFDACEDDYNYYYTRS

SEQ ID NO: 64092 - protein, 493 aa, Homo sapiens
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVMFAFSGTYTLLFVARTLQGIGSSFSSVAGLGMLASVYTDDHERGRAMGTALGGLALGLLVGAPFGSVMYEFVGKSAPFLILAFLALLDGALQLCILQPSKVSPESAKGTPLFMLLKDPYILVAAGLAFLPASVSYLIGTNLFGVLANKMGRWLCSLIGMLVVGTSLLCVPLAHNIFGLIGPNAGLGLAIGMVDSSMMPIMGHLVDLRHTSVYGSVYAIADVAFCMGFAIGPSTGGAIVKAIGFPWLMVITGVINIVYAPLCYYLRSPPAKEEKLAILSQDCPMETRMYATQKPTKEFPLGEDSDEEPDHEE

SEQ ID NO: 64093 - protein, 525 aa, Homo sapiens
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVMFAFSGTYTLLFVARTLQGIGSSFSSVAGLGMLASVYTDDHERGRAMGTALGGLALGLLVGAPFGSVMYEFVGKSAPFLILAFLALLDGALQLCILQPSKVSPESAKGTPLFMLLKDPYILVAAGSICFANMGVAILEPTLPIWMMQTMCSPKWQLGLAFLPASVSYLIGTNLFGVLANKMGRWLCSLIGMLVVGTSLLCVPLAHNIFGLIGPNAGLGLAIGMVDSSMMPIMGHLVDLRHTSVYGSVYAIADVAFCMGFAIGPSTGGAIVKAIGFPWLMVITGVINIVYAPLCYYLRSPPAKEEKLAILSQDCPMETRMYATQKPTKEFPLGEDSDEEPDHEE

SEQ ID NO: 64094 - protein, 472 aa, Homo sapiens
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVMFAFSGTYTLLFVARTLQGIGSSFSSVAGLGMLASVYTDDHERGRAMGTALGGLALGLLVGAPFGSVMYEFVGKSAPFLILAFLALLDGALQLCILQPSKVSPESAKGTPLFMLLKDPYILVAAGSICFANMGVAILEPTLPIWMMQTMCSPKWQLGLAFLPASVSYLIGTNLFGVLANKMGRWLCSLIGMLVVGTSLLCVPLAHNIFGLIGPNAGLGLAIGMVDSSMMPIMGHLVDLRHTSVYGSVYAIADVAFCMGFAIGYSESGLPHGDPDVCNPEAHEGISSGGGQ

SEQ ID NO: 64095 - protein, 525 aa, Homo sapiens; identical to SEQ ID NO: 64093

SEQ ID NO: 64096 - protein, 385 aa, Homo sapiens
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVMFAFSGTYTLLFVARTLQGIGSSFSSVAGLGMLASVYTDDHERGRAMGTALGGLALGLLVGAPFGSVMYEFVGKSAPFLILAFLALLDGALQLCILQPSKVSPESAKGTPLFMLLKDPYILVAAGSICFANMGVAILEPTLPIWMMQTMCSPKWQLGLAFLPASVSYLIGTNLFGVLANKMGRWLCSLIGMLVVGTSLLCLPS

SEQ ID NO: 64097 - protein, 493 aa, Homo sapiens; identical to SEQ ID NO: 64092

SEQ ID NO: 64098 - protein, 514 aa, Homo sapiens
MALSELALVRWLQESRRSRKLILFIVFLALLLDNMLLTVVVPIIPSYLYSIKHEKNATEIQTARPVHTASISDSFQSIFSYYDNSTMVTGNATRDLTLHQTATQHMVTNASAVPSDCPSEDKDLLNENVQVGLLFASKATVQLITNPFIGLLTNRIGYPIPIFAGFCIMFVSTIMFAFSSSYAFLLIARSLQGIGSSCSSVAGMGMLASVYTDDEERGNVMGIALGGLAMGVLVGPPFGSVLYEFVGKTAPFLVLAALVLLDGAIQLFVLQPSRVQPESQKGTPLTTLLKDPYILIAAGSICFANMGIAMLEPALPIWMMETMCSRKWQLGVAFLPASISYLIGTNIFGILAHKMGRWLCALLGMIIVGVSILCIPFAKNIYGLIAPNFGVGFAIGMVDSSMMPIMGYLVDLRHVSVYGSVYAIADVAFCMGYAIGPSAGGAIAKAIGFPWLMTIIGIIDILFAPLCFFLRSPPAKEEKMAILMDHNCPIKTKMYTQNNIQSYPIGEDEESESD

SEQ ID NO: 64099 - protein, 497 aa, Homo sapiens
MDVPGPVSRRAAAAAATVLLRTARVRRECWFLPTALLCAYGFFASLRPSEPFLTPYLLGPDKNLTEREVFNEIYPVWTYSYLVLLFPVFLATDYLRYKPVVLLQGLSLIVTWFMLLYAQGLLAIQFLEFFYGIATATEIAYYSYIYSVVDLGMYQKVTSYCRSATLVGFTVGSVLGQILVSVAGWSLFSLNVISLTCVSVAFAVAWFLPMPQKSLFFHHIPSTCQRVNGIKVQNGGIVTDTPASNHLPGWEDIESKIPLNMEEPPVEEPEPKPDRLLVLKVLWNDFLMCYSSRPLLCWSVWWALSTCGYFQVVNYTQGLWEKVMPSRYAAIYNGGVEAVSTLLGAVAVFAVGYIKISWSTWGEMTLSLFSLLIAAAVYIMDTVGNIWVCYASYVVFRIIYMLLITIATFQIAANLSMERYALVFGVNTFIALALQTLLTLIVVDASGLGLEITTQFLIYASYFALIAVVFLASGAVSVMKKCRKLEDPQSSSQVTTS

SEQ ID NO: 64100 - protein, 459 aa, Homo sapiens
MDVPGPVSRRAAAAAATVLLRTARVRRECWFLPTALLCAYGFFASLRPSEPFLTPYLLGPDKNLTEREVFNEIYPVWTYSYLVLLFPVFLATDYLRYKPVVLLQGLSLIVTWFMLLYAQGLLAIQFLEFFYGIATATEIAYYSYIYSVVDLGMYQKVTSYCRSATLVGFTVGSVLGQILVSVAGWSLFSLNVISLTCVSVAFAVAWFLPMPQKSLFFHHIPSTCQRVNGIKEPKPDRLLVLKVLWNDFLMCYSSRPLLCWSVWWALSTCGYFQVVNYTQGLWEKVMPSRYAAIYNGGVEAVSTLLGAVAVFAVGYIKISWSTWGEMTLSLFSLLIAAAVYIMDTVGNIWVCYASYVVFRIIYMLLITIATFQIAANLSMERYALVFGVNTFIALALQTLLTLIVVDASGLGLEITTQFLIYASYFALIAVVFLASGAVSVMKKCRKLEDPQSSSQVTTS

SEQ ID NO: 64101 - protein, 296 aa, Homo sapiens
MDVPGPVSRRAAAAAATVLLRTARVRRECWFLPTALLCAYGFFASLRPSEPFLTPYLLGPDKNLTEREEPKPDRLLVLKVLWNDFLMCYSSRPLLCWSVWWALSTCGYFQVVNYTQGLWEKVMPSRYAAIYNGGVEAVSTLLGAVAVFAVGYIKISWSTWGEMTLSLFSLLIAAAVYIMDTVGNIWVCYASYVVFRIIYMLLITIATFQIAANLSMERYALVFGVNTFIALALQTLLTLIVVDASGLGLEITTQFLIYASYFALIAVVFLASGAVSVMKKCRKLEDPQSSSQVTTS

SEQ ID NO: 64102 - protein, 496 aa, Homo sapiens
MDCYRTSLSSSWIYPTVILCLFGFFSMMRPSEPFLIPYLSGPDKNLTSAEITNEIFPVWTYSYLVLLLPVFVLTDYVRYKPVIILQGISFIITWLLLLFGQGVKTMQVVEFFYGMVTAAEVAYYAYIYSVVSPEHYQRVSGYCRSVTLAAYTAGSVLAQLLVSLANMSYFYLNVISLASVSVAFLFSLFLPMPKKSMFFHAKPSREIKKSSSVNPVLEETHEGEAPGCEEQKPTSEILSTSGKLNKGQLNSLKPSNVTVDVFVQWFQDLKECYSSKRLFYWSLWWAFATAGFNQVLNYVQILWDYKAPSQDSSIYNGAVEAIATFGGAVAAFAVGYVKVNWDLLGELALVVFSVVNAGSLFLMHYTANIWACYAGYLIFKSSYMLLITIAVFQIAVNLNVERYALVFGINTFIALVIQTIMTVIVVDQRGLNLPVSIQFLVYGSYFAVIAGIFLMRSMYITYSTKSQKDVQSPAPSENPDVSHPEEESNIIMSTKL

SEQ ID NO: 64103 - protein, 54 aa, Homo sapiens
MDCYRTSLSSSWIYPTVILCLFGFFSMMRPSEPFLIPYLSGPDKNLTSAEITNE

SEQ ID NO: 64104 - protein, 64 aa, Homo sapiens
MDCYRTSLSSSWIYPTVILCLFGFFSMMRPSEPFLIPYLSGPDKNLTSAEITNEIFPVWTYSYL

SEQ ID NO: 64105 - protein, 496 aa, Homo sapiens; identical to SEQ ID NO: 64102

SEQ ID NO: 64106 - protein, 132 aa, Homo sapiens
MDCYRTSLSSSWIYPTVILCLFGFFSMMRPSEPFLIPYLSGPDKNLTSAEITNEIFPVWTYSYLVLLLPVFVLTDYVRYKPVIILQGISFIITWLLLLFGQGVKTMQVVEFFYGMVTAAEVAYYAYIYSVVS

SEQ ID NO: 64107 - protein, 492 aa, Homo sapiens
MNPLGSASRATVDQLTDLPSKEQLSCVVFALWPPAFSSNLSDPGVKITNEIFPVWTYSYLVLLLPVFVLTDYVRYKPVIILQGISFIITWLLLLFGQGVKTMQVVEFFYGMVTAAEVAYYAYIYSVVSPEHYQRVSGYCRSVTLAAYTAGSVLAQLLVSLANMSYFYLNVISLASVSVAFLFSLFLPMPKKSMFFHAKPSREIKKSSSVNPVLEETHEGEAPGCEEQKPTSEILSTSGKLNKGQLNSLKPSNVTVDVFVQWFQDLKECYSSKRLFYWSLWWAFATAGFNQVLNYVQILWDYKAPSQDSSIYNGAVEAIATFGGAVAAFAVGYVKVNWDLLGELALVVFSVVNAGSLFLMHYTANIWACYAGYLIFKSSYMLLITIAVFQIAVNLNVERYALVFGINTFIALVIQTIMTVIVVDQRGLNLPVSIQFLVYGSYFAVIAGIFLMRSMYITYSTKSQKDVQSPAPSENPDVSHPEEESNIIMSTKL

SEQ ID NO: 64108 - protein, 541 aa, Homo sapiens
MGHSPPVLPLCASVSLLGGLTFGYELAVISGALLPLQLDFGLSCLEQEFLVGSLLLGALLASLVGGFLIDCYGRKQAILGSNLVLLAGSLTLGLAGSLAWLVLGRAVVGFAISLSSMACCIYVSELVGPRQRGVLVSLYEAGITVGILLSYALNYALAGTPWGWRHMFGWATAPAVLQSLSLLFLPAGTDETATHKDLIPLQGGEAPKLGPGRPRYSFLDLFRARDNMRGRTTVGLGLVLFQQLTGQPNVLCYASTIFSSVGFHGGSSAVLASVGLGAVKVAATLTAMGLVDRAGRRALLLAGCALMALSVSGIGLVSFAVPMDSGPSCLAVPNATGQTGLPGDSGLLQDSSLPPIPRTNEDQREPILSTAKKTKPHPRSGDPSAPPRLALSSALPGPPLPARGHALLRWTALLCLMVFVSAFSFGFGPVTWLVLSEIYPVEIRGRAFAFCNSFNWAANLFISLSFLDLIGTIGLSWTFLLYGLTAVLGLGFIYLFVPETKGQSLAEIDQQFQKRRFTLSFGHRQNSTGIPYSRIEISAAS

SEQ ID NO: 64109 - protein, 648 aa, Homo sapiens
MSRKASENVEYTLRSLSSLMGERRRKQPEPDAASAAGECSLLAAAESSTSLQSAGAGGGGVGDLERAARRQFQQDETPAFVYVVAVFSALGGFLFGYDTGVVSGAMLLLKRQLSLDALWQELLVSSTVGAAAVSALAGGALNGVFGRRAAILLASALFTAGSAVLAAANNKETLLAGRLVVGLGIGIASMTVPVYIAEVSPPNLRGRLVTINTLFITGGQFFASVVDGAFSYLQKDGWRYMLGLAAVPAVIQFFGFLFLPESPRWLIQKGQTQKARRILSQMRGNQTIDEEYDSIKNNIEEEEKEVGSAGPVICRMLSYPPTRRALIVGCGLQMFQQLSGINTIMYYSATILQMSGVEDDRLAIWLASVTAFTNFIFTLVGVWLVEKVGRRKLTFGSLAGTTVALIILALGFVLSAQVSPRITFKPIAPSGQNATCTRYSYCNECMLDPDCGFCYKMNKSTVIDSSCVPVNKASTNEAAWGRCENETKFKTEDIFWAYNFCPTPYSWTALLGLILYLVFFAPGMGPMPWTVNSEIYPLWARSTGNACSSGINWIFNVLVSLTFLHTAEYLTYYGAFFLYAGFAAVGLLFIYGCLPETKGKKLEEIESLFDNRLCTCGTSDSDEGRYIEYIRVKGSNYHLSDNDASDVE

SEQ ID NO: 64110 - protein, 357 aa, Homo sapiens
MSRKASENVEYTLRSLSSLMGERRRKQPEPDAASAAGECSLLAAAESSTSLQSAGAGGGGVGDLERAARRQFQQDETPAFVYVVAVFSALGGFLFGYDTGVVSGAMLLLKRQLSLDALWQELLVSSTVGAAAVSALAGGALNGVFGRRAAILLASALFTAGSAVLAAANNKETLLAGRLVVGLGIGIASMTVPVYIAEVSPPNLRGRLVTINTLFITGGQFFASVVDGAFSYLQKDGWRYMLGLAAVPAVIQFFGFLFLPESPRWLIQKGQTQKARRILSQMRGNQTIDEEYDSIKNNIEEEEKEVGSAGPVICRMLSYPPTRRALIVGCGLQMFQQLSGINTIMYVFLSGFLLKRL

SEQ ID NO: 64111 - protein, 497 aa, Homo sapiens
MDNRQNVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 64112 - protein, 520 aa, Homo sapiens
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 64113 - protein, 497 aa, Homo sapiens; identical to SEQ ID NO: 64111

SEQ ID NO: 64114 - protein, 120 aa, Homo sapiens
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLI

SEQ ID NO: 64115 - protein, 411 aa, Homo sapiens
MLLRRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 64116 - protein, 141 aa, Homo sapiens
MDNRQNVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPM

SEQ ID NO: 64117 - protein, 47 aa, Homo sapiens
MDNRQNVTPALIFAITVATIGSFQFGYNTGVINAPETIIKEFINKTL

SEQ ID NO: 64118 - protein, 22 aa, Homo sapiens
MDNRQNVTPALIFAITVATIGS

SEQ ID NO: 64119 - protein, 141 aa, Homo sapiens
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESV

SEQ ID NO: 64120 - protein, 535 aa, Homo sapiens
MQRLQLLRVEVLLGVKQGDEMRHFFFSSQTSTLEKSQNGGVGEEVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 64121 - protein, 161 aa, Homo sapiens
MIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 64122 - protein, 411 aa, Homo sapiens; identical to SEQ ID NO: 64115

SEQ ID NO: 64123 - protein, 152 aa, Homo sapiens
MDNRQNVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALR

SEQ ID NO: 64124 - protein, 84 aa, Homo sapiens
MDNRQNVTPALIFAITVATIGSFQFGYNTGVINAPETIIKEFINKTLTDKANAPPSEVLLTNLWSLSVAIFSVGGMIGSFSVGL

SEQ ID NO: 64125 - protein, 520 aa, Homo sapiens; identical to SEQ ID NO: 64112

SEQ ID NO: 64126 - protein, 169 aa, Homo sapiens
MDNRQNVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILV

SEQ ID NO: 64127 - protein, 496 aa, Homo sapiens
MGTQKVTPALIFAITVATIGSFQFGYNTGVINAPEKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIFGLEFILGSEELWPLLLGFTILPAILQSAALPFCPESPRFLLINRKEEENAKQILQRLWGTQDVSQDIQEMKDESARMSQEKQVTVLELFRVSSYRQPIIISIVLQLSQQLSGINAVFYYSTGIFKDAGVQEPIYATIGAGVVNTIFTVVSLFLVERAGRRTLHMIGLGGMAFCSTLMTVSLLLKDNYNGMSFVCIGAILVFVAFFEIGPGPIPWFIVAELFSQGPRPAAMAVAGCSNWTSNFLVGLLFPSAAHYLGAYVFIIFTGFLITFLAFTFFKVPETRGRTFEDITRAFEGQAHGADRSGKDGVMEMNSIEPAKETTTNV

SEQ ID NO: 64128 - protein, 422 aa, Homo sapiens
MIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIFGLEFILGSEELWPLLLGFTILPAILQSAALPFCPESPRFLLINRKEEENAKQILQRLWGTQDVSQDIQEMKDESARMSQEKQVTVLELFRVSSYRQPIIISIVLQLSQQLSGINAVFYYSTGIFKDAGVQEPIYATIGAGVVNTIFTVVSLFLVERAGRRTLHMIGLGGMAFCSTLMTVSLLLKDNYNGMSFVCIGAILVFVAFFEIGPGPIPWFIVAELFSQGPRPAAMAVAGCSNWTSNFLVGLLFPSAAHYLGAYVFIIFTGFLITFLAFTFFKVPETRGRTFEDITRAFEGQAHGADRSGKDGVMEMNSIEPAKETTTNV

SEQ ID NO: 64129 - protein, 509 aa, Homo sapiens
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAEAMGPYVFLLFAVLLLGFFIFTFLRVPETRGRTFDQISAAFHRTPSLLEQEVKPSTELEYLGPDEND

SEQ ID NO: 64130 - protein, 451 aa, Homo sapiens
MDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAVGPPAPASHTVGQRWASHS

SEQ ID NO: 64131 - protein, 445 aa, Homo sapiens
MQEPLLGAEGPDYDTFPEKPPPSPGDRARVGTLQNKRVFLATFAAVLGNFSFGYALVYTSPVIPALERSLDPDLHLTKSQASWFGSVFTLGAAAGGLSAMILNDLLGRKLSIMFSAVPSAAGYALMAGAHGLWMLLLGRTLTGFAGGLTAACIPVYVSEIAPPGVRGALGATPQLMAVFGSLSLYALGLLLPWRWLAVAGEAPVLIMILLLSFMPNSPRFLLSRGRDEEALRALAWLRGTDVDVHWEFEQIQDNVRRQSSRVSWAEARAPHVCRPITVALLMRLLQQLTGITPILVYLQSIFDSTAVLLPPKDDAAIVGAVRLLSVLIAALTMDLAGRKVLLFVSGYAVGWGPITWLLMSEVLPLRARGVASGLCVLASWLTAFVLTKSFLPVVSTFGLQVPFFFFAAICLVSLVFTGCCVPETKGRSLEQIESFFRTGRRSFLR

SEQ ID NO: 64132 - protein, 507 aa, Homo sapiens
MQEPLLGAEGPDYDTFPEKPPPSPGDRARVGTLQNKRVFLATFAAVLGNFSFGYALVYTSPVIPALERSLDPDLHLTKSQASWFGSVFTLGAAAGGLSAMILNDLLGRKLSIMFSAVPSAAGYALMAGAHGLWMLLLGRTLTGFAGGLTAACIPVYVSEIAPPGVRGALGATPQLMAVFGSLSLYALGLLLPWRWLAVAGEAPVLIMILLLSFMPNSPRFLLSRGRDEEALRALAWLRGTDVDVHWEFEQIQDNVRRQSSRVSWAEARAPHVCRPITVALLMRLLQQLTGITPILVYLQSIFDSTAVLLPPKDDAAIVGAVRLLSVLIAALTMDLAGRKVLLFVSAAIMFAANLTLGLYIHFGPRPLSPNSTAGLESESWGDLAQPLAAPAGYLTLVPLLATMLFIMGYAVGWGPITWLLMSEVLPLRARGVASGLCVLASWLTAFVLTKSFLPVVSTFGLQVPFFFFAAICLVSLVFTGCCVPETKGRSLEQIESFFRTGRRSFLR

SEQ ID NO: 64133 - protein, 146 aa, Homo sapiens
MILNDLLGRKLSIMFSAVPSAAGYALMAGAHGLWMLLLGRTLTGFAGGLTAACIPGLTLPSRPGLGTSIFSKTWCGGCVLQVYVSEIAPPGVRGALGATPQLMAVFGSLSLYALGKDEEALRALAWLRGTDVDVHWEFEQIQDNVR

SEQ ID NO: 64134 - protein, 219 aa, Homo sapiens
MQEPLLGAEGPDYDTFPEKPPPSPGDRARVGTLQNKRVFLATFAAVLGNFSFGYALVYTSPVIPALERSLDPDLHLTKSQASWFGSVFTLGAAAGGLSAMILNDLLGRKLSIMFSAVPSAAGYALMAGAHGLWMLLLGRTLTGFAGGLTAACIPVYVSEIAPPGVRGALGATPQLMAVFGSLSLYALGTKRPCGRWPGCVGRTSMSTGSSSRSRTTSGD

SEQ ID NO: 64135 - protein, 512 aa, Homo sapiens
MENKEAGTPPPIPSREGRLQPTLLLATLSAAFGSAFQYGYNLSVVNTPHKVFKSFYNETYFERHATFMDGKLMLLLWSCTVSMFPLGGLLGSLLVGLLVDSCGRKGTLLINNIFAIIPAILMGVSKVAKAFELIVFSRVVLGVCAGISYSALPMYLGELAPKNLRGMVGTMTEVFVIVGVFLAQIFSLQAILGNPAGWPVLLALTGVPALLQLLTLPFFPESPRYSLIQKGDEATARQALRRLRGHTDMEAELEDMRAEARAERAEGHLSVLHLCALRSLRWQLLSIIVLMAGQQLSGINAINYYADTIYTSAGVEAAHSQYVTVGSGVVNIVMTITSAVLVERLGRRHLLLAGYGICGSACLVLTVVLLFQNRVPELSYLGIICVFAYIAGHSIGPSPVPSVVRTEIFLQSSRRAAFMVDGAVHWLTNFIIGFLFPSIQEAIGAYSFIIFAGICLLTAIYIYVVIPETKGKTFVEINRIFAKRNRVKLPEEKEETIDAGPPTASPAKETSF

SEQ ID NO: 64136 - protein, 267 aa, Homo sapiens
MTCSLGKVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFP

SEQ ID NO: 64137 - protein, 214 aa, Homo sapiens
MAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 64138 - protein, 411 aa, Homo sapiens
MTPEDPEETQPLLGPPGGSAPRGRRVFLAAFAAALGPLSFGFALGYSSPAIPSLQRAAPPAPRLDDAAASWFGAVVTLGAAAGGVLGGWLVDRAGRKLSLLLCSVPFVAGFAVITAAQDVWMLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGGPQALWSLLACLRFLHLQCPFHFVLCP

SEQ ID NO: 64139 - protein, 477 aa, Homo sapiens
MTPEDPEETQPLLGPPGGSAPRGRRVFLAAFAAALGPLSFGFALGYSSPAIPSLQRAAPPAPRLDDAAASWFGAVVTLGAAAGGVLGGWLVDRAGRKLSLLLCSVPFVAGFAVITAAQDVWMLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 64140 - protein, 169 aa, Homo sapiens
  MOD_RES (1)..(1): Any amino acid
XGRRVFLAAFAAALGPLSFGFALGYSSPAIPSLQRAAPPAPRLDDAAASWFGVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQQLSGVNAVMFYAETIFEE

SEQ ID NO: 64141 - protein, 256 aa, Homo sapiens
MTPEDPEETQPLLGPPGGSAPRGRRVFLAAFAAALGPLSFGFALGYSSPAIPSLQRAAPPAPRLDDAAASWFGVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLS

SEQ ID NO: 64142 - protein, 267 aa, Homo sapiens; identical to SEQ ID NO: 64136

SEQ ID NO: 64143 - protein, 276 aa, Homo sapiens
QLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMLLLLL

SEQ ID NO: 64144 - protein, 241 aa, Homo sapiens
MTCSLGKVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFP

SEQ ID NO: 64145 - protein, 265 aa, Homo sapiens
MVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEF

SEQ ID NO: 64146 - protein, 540 aa, Homo sapiens
MARKQNRNSKELGLVPLTDDTSHAGPPGPGRALLECDHLRSGVPGGRRRKDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGKESTWPYLFGVIVVPAVVQLLSLPFLPDSPRYLLLEKHNEARAVKAFQTFLGKADVSQEVEEVLAESRVQRSIRLVSVLELLRAPYVRWQVVTVIVTMACYQLCGLNAIWFYTNSIFGKAGIPPAKIPYVTLSTGGIETLAAVFSGLVIEHLGRRPLLIGGFGLMGLFFGTLTITLTLQDHAPWVPYLSIVGILAIIASFCSGPGGIPFILTGEFFQQSQRPAAFIIAGTVNWLSNFAVGLLFPFIQKSLDTYCFLVFATICITGAIYLYFVLPETKNRTYAEISQAFSKRNKAYPPEEKIDSAVTDGKINGRP

SEQ ID NO: 64147 - protein, 511 aa, Homo sapiens
MKLSKKDRGEDEESDSAKKKLDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGKESTWPYLFGVIVVPAVVQLLSLPFLPDSPRYLLLEKHNEARAVKAFQTFLGKADVSQEVEEVLAESRVQRSIRLVSVLELLRAPYVRWQVVTVIVTMACYQLCGLNAIWFYTNSIFGKAGIPPAKIPYVTLSTGGIETLAAVFSGLVIEHLGRRPLLIGGFGLMGLFFGTLTITLTLQDHAPWVPYLSIVGILAIIASFCSGPGGIPFILTGEFFQQSQRPAAFIIAGTVNWLSNFAVGLLFPFIQKSLDTYCFLVFATICITGAIYLYFVLPETKNRTYAEISQAFSKRNKAYPPEEKIDSAVTDGKINGRP

SEQ ID NO: 64148 - protein, 511 aa, Homo sapiens; identical to SEQ ID NO: 64147

SEQ ID NO: 64149 - protein, 198 aa, Homo sapiens
MKLSKKDRGEDEESDSAKKKLDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGK

SEQ ID NO: 64150 - protein, 244 aa, Homo sapiens
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGEFRTSREHPHPFTTTLGPLLVFQSHHHRTGLSADWSLLTGWMSLGGPSCPEPT

SEQ ID NO: 64151 - protein, 501 aa, Homo sapiens
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 64152 - protein, 484 aa, Homo sapiens
MEQQDQSMKEGRLTLVLALAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 64153 - protein, 386 aa, Homo sapiens
MGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 64154 - protein, 442 aa, Homo sapiens
MLELHSLTASSIMRVLIMRAPLREAPPEKFALLLSGSPGKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 64155 - protein, 679 aa, Homo sapiens
MATLITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 64156 - protein, 378 aa, Homo sapiens [sequence omitted]

SEQ ID NO: 64157 - protein, 652 aa, Homo sapiens
MAMDEYLWMVILGFIIAFILAFSVGANDVANSFGTAVGSGVVTLRQACILASIFETTGSVLLGAKVGETIRKGIIDVNLYNETVETLMAGEVSAMVGSAVWQLIASFLRLPISGTHCIVGSTIGFSLVAIGTKGVQWMELVKIVASWFISPLLSGFMSGLLFVLIRIFILKKEDPVPNGLRALPVFYAATIAINVFSIMYTGAPVLGLVLPMWAIALISFGVALLFAFFVWLFVCPWMRRKITGKLQKEGALSRVSDESLSKVQEAESPVFKELPGAKANDDSTIPLTGAAGETLGTSEGTSAGSHPRAAYGRALSMTHGSVKSPISNGTFGFDGHTRSDGHVYHTVHKDSGLYKDLLHKIHIDRGPEEKPAQESNYRLLRRNNSYTCYTAAICGLPVHATFRAADSSAPEDSEKLVGDTVSYSKKRLRYDSYSSYCNAVAEAEIEAEEGGVEMKLASELADPDQPREDPAEEEKEEKDAPEVHLLFHFLQVLTACFGSFAHGGNDVSNAIGPLVALWLIYKQGGVTQEAATPVWLLFYGGVGICTGLWVWGRRVIQTMGKDLTPITPSSGFTIELASAFTVVIASNIGLPVSTTHCKVGSVVAVGWIRSRKAVDWRLFRNIFVAWFVTVPVAGLFSAAVMALLMYGILPYV

SEQ ID NO: 64158 - protein, 71 aa, Homo sapiens
MAMDEYLWMVILGFIIAFILAFSVGANDVANSFGTAVGSGVVTLRQACILASIFETTGSVLLGAKVGETIR

SEQ ID NO: 64159 - protein, 28 aa, Homo sapiens
MAMDEYLWMVILGFIIAFILAFSVGAND

SEQ ID NO: 64160 - protein, 78 aa, Homo sapiens
MAMDEYLWMVILGFIIAFILAFSVGANDVANSFGTAVGSGVVTLRQACILASIFETTGSVLLGAKVGETIRKGIIDVN

SEQ ID NO: 64161 - protein, 652 aa, Homo sapiens; identical to SEQ ID NO: 64157

SEQ ID NO: 64162 - protein, 652 aa, Homo sapiens; identical to SEQ ID NO: 64157

SEQ ID NO: 64163 - protein, 47 aa, Homo sapiens
MAMDEYLWMVILGFIIAFILAFSVGANDVANSFGTAVGSGVVTLRQA

SEQ ID NO: 64164 - protein, 419 aa, Homo sapiens
MAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 64165 - protein, 451 aa, Homo sapiens
MEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 64166 - protein, 550 aa, Homo sapiens
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRKGKQTRQQQEHQKYMVPLQASAQEKNGL

SEQ ID NO: 64167 - protein, 563 aa, Homo sapiens
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRWAPTQKEAGIYPRKGKQTRQQQEHQKYMVPLQASAQEKNGL

SEQ ID NO: 64168 - protein, 529 aa, Homo sapiens
MAFNDLLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRKGKQTRQQQEHQKYMVPLQASAQEKNGL

SEQ ID NO: 64169 - protein, 519 aa, Homo sapiens
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRAVTVLLPETLGQPLPDTVQDLESRWAPTQKEAGIYPRKGKQTRQQQEHQKYMVPLQASAQEKNGL

SEQ ID NO: 64170 - protein, 506 aa, Homo sapiens
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRAVTVLLPETLGQPLPDTVQDLESRKGKQTRQQQEHQKYMVPLQASAQEKNGL

SEQ ID NO: 64171 - protein, 539 aa, Homo sapiens
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATEWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKRCVHRTVSVYV

SEQ ID NO: 64172 - protein, 548 aa, Homo sapiens
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATESQWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKSAPTSLQEEEMPMKQVQN

SEQ ID NO: 64173 - protein, 546 aa, Homo sapiens
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATEWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKSAPTSLQEEEMPMKQVQN

SEQ ID NO: 64174 - protein, 211 aa, Homo sapiens
MLQPHLLPYQAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQA

SEQ ID NO: 64175 - protein, 278 aa, Homo sapiens
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATESQVGIYIIHLEVECRWRQSPWEAAGRGLPWEEAEAAGLGRDKVSYSPSWRESLGGLLSGMEWDLVCEQKGLNRAASTFFFAGVLVGAVAFGYLSDRFGRRRLLLVAYVSTLVLGLASAASVSYVMFAITRTLTGSALAGFTIIVMPL

SEQ ID NO: 64176 - protein, 147 aa, Homo sapiens
MEWDLVCEQKGLNRAASTFFFAGVLVGAVAFGYLSDRFGRRRLLLVAYVSTLVLGLASAASVSYVMFAITRTLTGSALAGFTIIVMPLGEAELEWLDVEHRTVAGVLSSTFWTGGVMLLALVGYLIRDWRWLLLAVTLPCAPGILSL

SEQ ID NO: 64177 - protein, 542 aa, Homo sapiens
MTFSEILDRVGSMGHFQFLHVAILGLPILNMANHNLLQIFTAATPVHHCRPPHNASTGPWVLPMGPNGKPERCLRFVHPPNASLPNDTQRAMEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 64178 - protein, 542 aa, Homo sapiens; identical to SEQ ID NO: 64177

SEQ ID NO: 64179 - protein, 528 aa, Homo sapiens
MTFSEILDRVGSMGHFQFLHVAILGLPILNMANHCRPPHNASTGPWVLPMGPNGKPERCLRFVHPPNASLPNDTQRAMEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 64180 - protein, 550 aa, Homo sapiens
MAFSKLLEQAGGVGLFQTLQVLTFILPCLMIPSQMLLENFSAAIPGHRCWTHMLDNGSAVSTNMTPKALLTISIPPGPNQGPHQCRRFRQPQWQLLDPNATATSWSEADTEPCVDGWVYDRSVFTSTIVAKWDLVCSSQGLKPLSQSIFMSGILVGSFIWGLLSYRFGRKPMLSWCCLQLAVAGTSTIFAPTFVIYCGLRFVAAFGMAGIFLSSLTLMVEWTTTSRRAVTMTVVGCAFSAGQAALGGLAFALRDWRTLQLAASVPFFAISLISWWLPESARWLIIKGKPDQALQELRKVARINGHKEAKNLTIEVLMSSVKEEVASAKEPRSVLDLFCVPVLRWRSCAMLVVNFSLLISYYGLVFDLQSLGRDIFLLQALFGAVDFLGRATTALLLSFLGRRTIQAGSQAMAGLAILANMLVPQDLQTLRVVFAVLGKGCFGISLTCLTIYKAELFPTPVRMTADGILHTVGRLGAMMGPLILMSRQALPLLPPLLYGVISIASSLVVLFFLPETQGLPLPDTIQDLESQKSTAAQGNRQEAVTVESTSL

SEQ ID NO: 64181 - protein, 445 aa, Homo sapiens
MAFSELLDLVGGLGRFQVLQTMALMVSIMWLCTQSMLENFSAAVPSHRCWAPLLDNSTAQASILGSLSPEALLAISIPPGPNQRPHQCRRFRQPQWQLLDPNATATSWSEADTEPCVDGWVYDRSIFTSTIVAKWNLVCDSHALKPMAQSIYLAGILVGAAACGPASDRWLAESARWLLTTGRLDWGLQELWRVAAINGKGAVQDTLTPEVLLSAMREELSMGQPPASLGTLLRMPGLRFRTCISTLCWFAFGFTFFGLALDLQALGSNIFLLQMFIGVVDIPAKMGALLLLSHLGRRPTLAASLLLAGLCILANTLVPHEMGALRSALAVLGLGGVGAAFTCITIYSSELFPTVLRMTAVGLGQMAARGGAILGPLVRLLGVHGPWLPLLVYGTVPVLSGLAALLLPETQSLPLPDTIQDVQNQAVKKATHGTLGNSVLKSTQF

SEQ ID NO: 64182 - protein, 553 aa, Homo sapiens
MAFSELLDLVGGLGRFQVLQTMALMVSIMWLCTQSMLENFSAAVPSHRCWAPLLDNSTAQASILGSLSPEALLAISIPPGPNQRPHQCRRFRQPQWQLLDPNATATSWSEADTEPCVDGWVYDRSIFTSTIVAKWNLVCDSHALKPMAQSIYLAGILVGAAACGPASDRFGRRLVLTWSYLQMAVMGTAAAFAPAFPVYCLFRFLLAFAVAGVMMNTGTLLMEWTAARARPLVMTLNSLGFSFGHGLTAAVAYGVRDWTLLQLVVSVPFFLCFLYSWWLAESARWLLTTGRLDWGLQELWRVAAINGKGAVQDTLTPEVLLSAMREELSMGQPPASLGTLLRMPGLRFRTCISTLCWFAFGFTFFGLALDLQALGSNIFLLQMFIGVVDIPAKMGALLLLSHLGRRPTLAASLLLAGLCILANTLVPHEMGALRSALAVLGLGGVGAAFTCITIYSSELFPTVLRMTAVGLGQMAARGGAILGPLVRLLGVHGPWLPLLVYGTVPVLSGLAALLLPETQSLPLPDTIQDVQNQAVKKATHGTLGNSVLKSTQF

SEQ ID NO: 64183 - protein, 332 aa, Homo sapiens
MEWTAARARPLVMTLNSLGFSFGHGLTAAVAYGVRDWTLLQLVVSVPFFLCFLYSWWLAESARWLLTTGRLDWGLQELWRVAAINGKGAVQDTLTPEVLLSAMREELSMGQPPASLGTLLRMPGLRFRTCISTLCWFAFGFTFFGLALDLQALGSNIFLLQMFIGVVDIPAKMGALLLLSHLGRRPTLAASLLLAGLCILANTLVPHEMGALRSALAVLGLGGVGAAFTCITIYSSELFPTVLRMTAVGLGQMAARGGAILGPLVRLLGVHGPWLPLLVYGTVPVLSGLAALLLPETQSLPLPDTIQDVQNQAVKKATHGTLGNSVLKSTQF

SEQ ID NO: 64184 - protein, 554 aa, Homo sapiens
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEFNLVCADSWKLDLFQSCLNAGFLFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYWCVPESPRWLLSQKRNTEAIKIMDHIAQKNGKLPPADLKMLSLEEDVTEKLSPSFADLFRTPRLRKRTFILMYLWFTDSVLYQGLILHMGATSGNLYLDFLYSALVEIPGAFIALITIDRVGRIYPMAMSNLLAGAACLVMIFISPDLHWLNIIIMCVGRMGITIAIQMICLVNAELYPTFVRNLGVMVCSSLCDIGGIITPFIVFRLREVWQALPLILFAVLGLLAAGVTLLLPETKGVALPETMKDAENLGRKAKPKENTIYLKVQTSEPSGT

SEQ ID NO: 64185 - protein, 334 aa, Homo sapiens
MFFLLALLSATFAPIYVGIVFLGFTPDHRCRSPGVAELSLRCGWSPAEELNYTVPGPGPAGEASPRQCRRYEVDWNQSTFDCVDPLASLDTNRSRLPLGPCRDGWVYETPGSSIVTEFNLVCANSWMLDLFQSSVNVGFFIGSMSIGYIADRFGRKLCLLTTVLINAAAGVLMAISPTYTWMLIFRLIQGLVSKAGWLIGYILITEFVGRRYRRTVGIFYQVAYTVGLLVLAGVAYALPHWRWLQFTVSLPNFFFLLYYWCIPESPRWLISQNKNAEAMRIIKHIAKKNGKSLPASLQRLRLEEETGKKLNPSFLDLVRTPQIRKHTMILMYNW

SEQ ID NO: 64186 - protein, 555 aa, Homo sapiens
MPTTVDDVLEHGGEFHFFQKQMFFLLALLSATFAPIYVGIVFLGFTPDHRCRSPGVAELSLRCGWSPAEELNYTVPGPGPAGEASPRQCRRYEVDWNQSTFDCVDPLASLDTNRSRLPLGPCRDGWVYETPGSSIVTEFNLVCANSWMLDLFQSSVNVGFFIGSMSIGYIADRFGRKLCLLTTVLINAAAGVLMAISPTYTWMLIFRLIQGLVSKAGWLIGYILITEFVGRRYRRTVGIFYQVAYTVGLLVLAGVAYALPHWRWLQFTVSLPNFFFLLYYWCIPESPRWLISQNKNAEAMRIIKHIAKKNGKSLPASLQRLRLEEETGKKLNPSFLDLVRTPQIRKHTMILMYNWFTSSVLYQGLIMHMGLAGDNIYLDFFYSALVEFPAAFMIILTIDRIGRRYPWAASNMVAGAACLASVFIPGDLQWLKIIISCLGRMGITMAYEIVCLVNAELYPTFIRNLGVHICSSMCDIGGIITPFLVYRLTNIWLELPLMVFGVLGLVAGGLVLLLPETKGKALPETIEEAENMQRPRKNKEKMIYLQVQKLDIPLN

SEQ ID NO: 64187 - protein, 543 aa, Homo sapiens
MRTLHAVSHPYSNSMRFQRVLYFICAFQNISCGIHYLASVFMGVTPHHVCRPPGNLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 64188 - protein, 577 aa, Homo sapiens
MGSRHFEGIYDHVGHFGRFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 64189 - protein, 174 aa, Homo sapiens
MGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAM

SEQ ID NO: 64190 - protein, 267 aa, Homo sapiens
MSAGPQAMLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQ

SEQ ID NO: 64191 - protein, 351 aa, Homo sapiens
MGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLL

SEQ ID NO: 64192 - protein, 515 aa, Homo sapiens
MGSRHFEGIYDHVGHFGRFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLLGQHLQE

SEQ ID NO: 64193 - protein, 432 aa, Homo sapiens
DYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLLGQHLQE

SEQ ID NO: 64194 - protein, 199 aa, Homo sapiens
MGSRHFEGIYDHVGHFGRFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRVGFLTAWYKTSGFPTSSAPPL

SEQ ID NO: 64195 - protein, 557 aa, Homo sapiens
MRDYDEVTAFLGEWGPFQRLIFFLLSASIIPNGFTGLSSVFLIATPEHRCRVPDAANLSSAWRNHTVPLRLRDGREVPHSCRRYRLATIANFSALGLEPGRDVDLGQLEQESCLDGWEFSQDVYLSTIVTEWNLVCEDDWKAPLTISLFFVGVLLGSFISGQLSDRFGRKNVLFVTMGMQTGFSFLQIFSKNFEMFVVLFVLVGMGQISNYVAAFVLGTEILGKSVRIIFSTLGVCIFYAFGYMVLPLFAYFIRDWRMLLVALTMPGVLCVALWWFIPESPRWLISQGRFEEAEVIIRKAAKANGIVVPSTIFDPSELQDLSSKKQQSHNILDLLRTWNIRMVTIMSIMLWMTISVGYFGLSLDTPNLHGDIFVNCFLSAMVEVPAYVLAWLLLQYLPRRYSMATALFLGGSVLLFMQLVPPDLYYLATVLVMVGKFGVTAAFSMVYVYTAELYPTVVRNMGVGVSSTASRLGSILSPYFVYLGAYDRFLPYILMGSLTILTAILTLFLPESFGTPLPDTIDQMLRVKGMKHRKTPSHTRMLKDGQERPTILKSTAF

SEQ ID NO: 64196 - protein, 581 aa, Homo sapiens
MRDYDEVTAFLGEWGPFQRLIFFLLSASIIPNGFTGLSSVFLIATPEHRCRVPDAANLSSAWRNHTVPLRLRDGREVPHSCRRYRLATIANFSALGLEPGRDVDLGQLEQESCLDGWEFSQDVYLSTIVTEQDSGAYNAMKNRMGKKPALCLPAQWNLVCEDDWKAPLTISLFFVGVLLGSFISGQLSDRFGRKNVLFVTMGMQTGFSFLQIFSKNFEMFVVLFVLVGMGQISNYVAAFVLGTEILGKSVRIIFSTLGVCIFYAFGYMVLPLFAYFIRDWRMLLVALTMPGVLCVALWWFIPESPRWLISQGRFEEAEVIIRKAAKANGIVVPSTIFDPSELQDLSSKKQQSHNILDLLRTWNIRMVTIMSIMLWMTISVGYFGLSLDTPNLHGDIFVNCFLSAMVEVPAYVLAWLLLQYLPRRYSMATALFLGGSVLLFMQLVPPDLYYLATVLVMVGKFGVTAAFSMVYVYTAELYPTVVRNMGVGVSSTASRLGSILSPYFVYLGAYDRFLPYILMGSLTILTAILTLFLPESFGTPLPDTIDQMLRVKGMKHRKTPSHTRMLKDGQERPTILKSTAF

SEQ ID NO: 64197 - protein, 551 aa, Homo sapiens
MRDYDEVIAFLGEWGPFQRLIFFLLSASIIPNGFNGMSVVFLAGTPEHRCRVPDAANLSSAWRNNSVPLRLRDGREVPHSCSRYRLATIANFSALGLEPGRDVDLGQLEQESCLDGWEFSQDVYLSTVVTEWNLVCEDNWKVPLTTSLFFVGVLLGSFVSGQLSDRFGRKNVLFATMAVQTGFSFLQIFSISWEMFTVLFVIVGMGQISNYVVAFILGTEILGKSVRIIFSTLGVCTFFAVGYMLLPLFAYFIRDWRMLLLALTVPGVLCVPLWWFIPESPRWLISQRRFREAEDIIQKAAKMNNIAVPAVIFDSVEELNPLKQQKAFILDLFRTRNIAIMTIMSLLLWMLTSVGYFALSLDAPNLHGDAYLNCFLSALIEIPAYITAWLLLRTLPRRYIIAAVLFWGGGVLLFIQLVPVDYYFLSIGLVMLGKFGITSAFSMLYVFTAELYPTLVRNMAVGVTSTASRVGSIIAPYFVYLGAYNRMLPYIVMGSLTVLIGILTLFFPESLGMTLPETLEQMQKVKWFRSGKKTRDSMETEENPKVLITAF

SEQ ID NO: 64198 - protein, 551 aa, Homo sapiens
MGFDVLLDQVGGMGRFQICLIAFFCITNILLFPNIVLENFTAFTPSHRCWVPLLDNDTVSDNDTGTLSKDDLLRISIPLDSNLRPQKCQRFIHPQWQLLHLNGTFPNTNEPDTEPCVDGWVYDRSSFLSTIVTEWDLVCESQSLKSMVQSLFMAGSLLGGLIYGHLSDRVGRKIICKLCFLQLAISNTCAAFAPTFLVYCILRFLAGFSTMTILGNTFILSLEWTLPRSRSMTIMVLLCSYSVGQMLLGGLAFAIQDWHILQLTVSTPIIVLFLSSWKMVESARWLIINNQLDEGLKELRRVAHINGKKNTEETLTTELVRSTMKKELDAVRIKTSIFSLFRAPKLRMRVFGLCFVRFAITVPFYGLILNLQHLGSNVSLFQILCGAVTFTARCVSLLTLNHMGRRISQILFTFPVGLFILVNTFLPQEMQILRVVLATLGIGSVSAASNSASVHHNELVPTILRSTVAGINAVSGRTGAALAPLLMTLMAYSPHLPWISYGVFPILAVPVILLLPETRDLPLPNTIQDVENEKDSRNIKQEDTCMKVTQF

SEQ ID NO: 64199 - protein, 245 aa, Homo sapiens
MEVEEAFQAVGEMGIYQMYLCFLLAVLLQLYVATEAILIALVGATPSYHWDLAELLPNQSHGNQSAGEDQAFGDWLLTANGSEIHKHVHFSSSFTSIASEWFLIANRSYKVSAASSFFFSGVFVGVISFGQLSDRFGRKKVYLTGFALDILFAIANGFSPSYEFFAVTRFLVGMMNGGMSLVAFVLLNECVGTAYWALAGSIGGLFFAVGIAQYALLGYFIRSWRTLAILVNLQGTVVFLLSLVD

SEQ ID NO: 64200 - protein, 547 aa, Homo sapiens
MEVEEAFQAVGEMGIYQMYLCFLLAVLLQLYVATEAILIALVGATPSYHWDLAELLPNQSHGNQSAGEDQAFGDWLLTANGSEIHKHVHFSSSFTSIASEWFLIANRSYKVSAASSFFFSGVFVGVISFGQLSDRFGRKKVYLTGFALDILFAIANGFSPSYEFFAVTRFLVGMMNGGMSLVAFVLLNECVGTAYWALAGSIGGLFFAVGIAQYALLGYFIRSWRTLAILVNLQGTVVFLLSLFIPESPRWLYSQGRLSEAEEALYLIAKRNRKLKCTFSLTHPANRSCRETGSFLDLFRYRVLLGHTLILMFIWFVCSLVYYGLTLSAGDLGGSIYANLALSGLIEIPSYPLCIYLINQKWFGRKRTLSAFLCLGGLACLIVMFLPEKKDTGVFAVVNSHSLSLLGKLTISAAFNIVYIYTSELYPTVIRNVGLGTCSMFSRVGGIIAPFIPSLKYVQWSLPFIVFGATGLTSGLLSLLLPETLNSPLLETFSDLQVYSYRRLGEEALSLQALDPQQCVDKESSLGSESEEEEEFYDADEETQMIK

SEQ ID NO: 64201 - protein, 538 aa, Homo sapiens
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDCEHPIFPTVWAQQGNPNRDLNEAAITTFSVLGLFSSQAAAILSTLLAAEVIPTTVRGRGLGLIMALGALGGLSGPAQRLHMGHGAFLQHVVLAACALLCILSIMLLPETKRKLLPEVLRDGELCRRPSLLRQPPPTRCDHVPLLATPNPAL

SEQ ID NO: 64202 - protein, 520 aa, Homo sapiens
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDYLNEAAITTFSVLGLFSSQAAAILSTLLAAEVIPTTVRGRGLGLIMALGALGGLSGPAQRLHMGHGAFLQHVVLAACALLCILSIMLLPETKRKLLPEVLRDGELCRRPSLLRQPPPTRCDHVPLLATPNPAL

SEQ ID NO: 64203 - protein, 538 aa, Homo sapiens; identical to SEQ ID NO: 64201

SEQ ID NO: 64204 - protein, 361 aa, Homo sapiens
MAIDRRREAAGGGPGRQPAPAEENGSLPPGDAAASAPLGGRAGPGGGAEIQPLPPLHPGGGPHPSCCSAAAAPSLLLLDYDGSVLPFLGGLGGGYQKTLVLLTWIPALFIGFSQFSDSFLLDQPNFWCRGAGKGTELAGVTTTGRGGDMGNWTSLPTTPFATAPWEAAGNRSNSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWS

SEQ ID NO: 64205 - protein, 405 aa, Homo sapiens
MFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSGMSDSVKDKFSIAFSIVGMFASHAVGSLSVFFCAEITPTVIRCGGLGLVLASAGFGMLTAPIIELHNQKGYFLHHIIFACCTLICIICILLLPESRDQNLPENISNGEHYTRQPLLPHKKGEQPLLLTNAELKDYSGLHDAAAAGDTLPEGATANGMKAM

SEQ ID NO: 64206 - protein, 686 aa, Homo sapiens
MAIDRRREAAGGGPGRQPAPAEENGSLPPGDAAASAPLGGRAGPGGGAEIQPLPPLHPGGGPHPSCCSAAAAPSLLLLDYDGSVLPFLGGLGGGYQKTLVLLTWIPALFIGFSQFSDSFLLDQPNFWCRGAGKGTELAGVTTTGRGGDMGNWTSLPTTPFATAPWEAAGNRSNSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSGMSDSVKDKFSIAFSIVGMFASHAVGSLSVFFCAEITPTVIRCGGLGLVLASAGFGMLTAPIIELHNQKGYFLHHIIFACCTLICIICILLLPESRDQNLPENISNGEHYTRQPLLPHKKGEQPLLLTNAELKDYSGLHDAAAAGDTLPEGATANGMKAM

SEQ ID NO: 64207 - protein, 405 aa, Homo sapiens; identical to SEQ ID NO: 64205

SEQ ID NO: 64208 - protein, 322 aa, Homo sapiens
MGFDVLLDQVGGMGRFQICLIAFFCITNILLFPNIVLENFTAFTPSHRCWVPLLDNDTVSDNDTGTLSKDDLLRISIPLDSNLRPQKCQRFIHPQWQLLHLNGTFPNTNEPDTEPCVDGWVYDRSSFLSTIVTEWDLVCESQSLKSMVQSLFMAGSLLGGLIYGHLSDRVGRKIICKLCFLQLAISNTCAAFAPTFLVYCILRFLAGFSTMTILGNTFILSLEWTLPRSRSMTIMVLLCSYSVGQMLLGGLAFAIQDWHILQLTVSTPIIVLFLSSWYEQSPHSLPVSEAMVDIERKILTPGICSVSGLVLSHDVHSTYCVT

SEQ ID NO: 64209 - protein, 259 aa, Homo sapiens
MRAQEDLEGRTQHETTRDPSTPLPTEPKFDMLYKIEDVPPWYLCILLGFQHYLTCFSGTIAVPFLLAEALCVGHDQHMVSQLIGTIFTCVGMFCTLFGMITAVGLSNLQFVDMNSSRNLFVLGFSMFFGLTLPNYLESNPGAINTGILEVDQILIVLLTTEMFVGGCLAFILDNTVPGSPEERGLIQWKAGAHANSDMSSSLKSYDFPIGMGIVKRITFLKYIPICPVFKGFSSSSKDQIAIPEDTPENTETASVCTKV

SEQ ID NO: 64210 - protein, 598 aa, Homo sapiens
MRAQEDLEGRTQHETTRDPSTPLPTEPKFDMLYKIEDVPPWYLCILLGFQHYLTCFSGTIAVPFLLAEALCVGHDQHMVSQLIGTIFTCVGITTLIQTTVGIRLPLFQASAFAFLVPAKAILALERWKCPPEEEIYGNWSLPLNTSHIWHPRIREVQGAIMVSSVVEVVIGLLGLPGALLNYIGPLTVTPTVSLIGLSVFQAAGDRAGSHWGISACSILLIILFSQYLRNLTFLLPVYRWGKGLTLLRIQIFKMFPIMLAIMTVWLLCYVLTLTDVLPTDPKAYGFQARTDARGDIMAIAPWIRIPYPCQWGLPTVTAAAVLGMFSATLAGIIESIGDYYACARLAGAPPPPVHAINRGIFTEGICCIIAGLLGTGNGSTSSSPNIGVLGITKVGSRRVVQYGAAIMLVLGTIGKFTALFSSLPDPILGGMFCTLFGMITAVGLSNLQFVDMNSSRNLFVLGFSMFFGLTLPNYLESNPGAINTGILEVDQILIVLLTTEMFVGGCLAFILDNTVPGSPEERGLIQWKAGAHANSDMSSSLKSYDFPIGMGIVKRITFLKYIPICPVFKGFSSSSKDQIAIPEDTPENTETASVCTKV

SEQ ID NO: 64211 - protein, 602 aa, Homo sapiens
MRAQEDLEGRTQHETTRDPSTPLPTEPKFDMLYKIEDVPPWYLCILLGFQHYLTCFSGTIAVPFLLAEALCVGHDQHMVSQLIGTIFTCVGITTLIQTTVGIRLPLFQASAFAFLVPAKAILALERWKCPPEEEIYGNWSLPLNTSHIWHPRIREVGLHVQGAIMVSSVVEVVIGLLGLPGALLNYIGPLTVTPTVSLIGLSVFQAAGDRAGSHWGISACSILLIILFSQYLRNLTFLLPVYRWGKGLTLLRIQIFKMFPIMLAIMTVWLLCYVLTLTDVLPTDPKAYGFQARTDARGDIMAIAPWIRIPYPCQWGLPTVTAAAVLGMFSATLAGIIESIGDYYACARLAGAPPPPVHAINRGIFTEGICCIIAGLLGTGNGSTSSSPNIGVLGITKVGSRRVVQYGAAIMLVLGTIGKFTALFSSLPDPILGGMFCTLFGMITAVGLSNLQFVDMNSSRNLFVLGFSMFFGLTLPNYLESNPGAINTGILEVDQILIVLLTTEMFVGGCLAFILDNTVPGSPEERGLIQWKAGAHANSDMSSSLKSYDFPIGMGIVKRITFLKYIPICPVFKGFSSSSKDQIAIPEDTPENTETASVCTKV

SEQ ID NO: 64212 - protein, 392 aa, Homo sapiens
MRAQEDLEGRTQHETTRDPSTPLPTEPKFDMLYKIEDVPPWYLCILLGFQHYLTCFSGTIAVPFLLAEALCVGHDQHMVSQLIGTIFTCVGITTLIQTTVGIRLPLFQASAFAFLVPAKAILALERWKCPPEEEIYGNWSLPLNTSHIWHPRIREVGLHVSIEEAGGYMGVRVAAEFGDLRRWSRSFVPASSSQVQGAIMVSSVVEVVIGLLGLPGALLNYIGPLTVTPTVSLIGLSVFQAAGDRAGSHWGISACSILLIILFSQYLRNLTFLLPCAQQSAPLWQASLSPSEITTPVPAWLVHHPLQYMLSTGASSPKAFAASSRGYWARATGPPRPVPTLASWELPRWAAGAWCSMVRLSCWSWAPSASSRPSSPRSLTPSWGACSALSLA

SEQ ID NO: 64213 - protein, 650 aa, Homo sapiens
MMGIGKNTTSKSMEAGSSTEGKYEDEAKHPAFFTLPVVINGGATSSGEQDNEDTELMAIYTTENGIAEKSSLAETLDSTGSLDPQRSDMIYTIEDVPPWYLCIFLGLQHYLTCFSGTIAVPFLLADAMCVGYDQWATSQLIGTIFFCVGITTLLQTTFGCRLPLFQASAFAFLAPARAILSLDKWKCNTTDVSVANGTAELLHTEHIWYPRIREIQGAIIMSSLIEVVIGLLGLPGALLKYIGPLTITPTVALIGLSGFQAAGERAGKHWGIAMLTIFLVLLFSQYARNVKFPLPIYKSKKGWTAYKLQLFKMFPIILAILVSWLLCFIFTVTDVFPPDSTKYGFYARTDARQGVLLVAPWFKVPYPFQWGLPTVSAAGVIGMLSAVVASIIESIGDYYACARLSCAPPPPIHAINRGIFVEGLSCVLDGIFGTGNGSTSSSPNIGVLGITKVGSRRVIQCGAALMLALGMIGKFSALFASLPDPVLGALFCTLFGMITAVGLSNLQFIDLNSSRNLFVLGFSIFFGLVLPSYLRQNPLVTGITGIDQVLNVLLTTAMFVGGCVAFILDNTIPGTPEERGIRKWKKGVGKGNKSLDGMESYNLPFGMNIIKKYRCFSYLPISPTFVGYTWKGLRKSDNSRSSDEDSQATG

SEQ ID NO: 64214 - protein, 650 aa, Homo sapiens; identical to SEQ ID NO: 64213

SEQ ID NO: 64215 - protein, 304 aa, Homo sapiens
  MOD_RES (1)..(1): Any amino acid
XGYDQWATSQLIGTIFFCVGITTLLQTTFGCRTIFLVLLFSQYARNVKFPLPIYKSKKGWTAYKLQLFKMFPIILAILVSWLLCFIFTVTDVFPPDSTKYGFYARTDARQGVLLVAPWFKVPYPFQWGLPTVSAAGVIGMLSAVVASIIESIGDYYACARLSCAPPPPIHAINRGIFVEGLSCVLDGIFGTGNGSTSSSPNIGVLGITKVGSRRVIQCGAALMLALGMIGKFSALFASLPDPVLGALFCTLFGMITAVGLSNLQFIDLNSSRNLFVLGFSIFFGLVLPSYLRQNPLVTGITGID

SEQ ID NO: 64216 - protein, 536 aa, Homo sapiens
MMGIGKNTTSKSMEAGSSTEGKYEDEAKHPAFFTLPVVINGGATSSGEQDNEDTELMAIYTTENGIAEKSSLAETLDSTGSLDPQRSDMIYTIEDVPPWYLCIFLGLQHYLTCFSGTIAVPFLLADAMCVGYDQWATSQLIGTIFFCVGITTLLQTTFGCRTIFLVLLFSQYARNVKFPLPIYKSKKGWTAYKLQLFKMFPIILAILVSWLLCFIFTVTDVFPPDSTKYGFYARTDARQGVLLVAPWFKVPYPFQWGLPTVSAAGVIGMLSAVVASIIESIGDYYACARLSCAPPPPIHAINRGIFVEGLSCVLDGIFGTGNGSTSSSPNIGVLGITKVGSRRVIQCGAALMLALGMIGKFSALFASLPDPVLGALFCTLFGMITAVGLSNLQFIDLNSSRNLFVLGFSIFFGLVLPSYLRQNPLVTGITGIDQVLNVLLTTAMFVGGCVAFILDNTIPGTPEERGIRKWKKGVGKGNKSLDGMESYNLPFGMNIIKKYRCFSYLPISPTFVGYTWKGLRKSDNSRSSDEDSQATG

SEQ ID NO: 64217 - protein, 1099 aa, Homo sapiens
MGKLIRMGPQERWLLRTKRLHWSRLLFLLGMLIIGSTYQHLRRPRGLSSLWAAVSSHQPIKLASRDLSSEEMMMMSSSPSKPSSEMGGKMLVPQASVGSDEATLSMTVENIPSMPKRTAKMIPTTTKNNYSPTAAGTERRKEDTPTSSRTLTYYTSTSSRQIVKKYTPTPRGEMKSYSPTQVREKVKYTPSPRGRRVGTYVPSTFMTMETSHAITPRTTVKDSDITATYKILETNSLKRIMEETTPTTLKGMFDSTPTFLTHEVEANVLTSPRSVMEKNNLFPPRRVESNSSAHPWGLVGKSNPKTPQGTVLLHTPATSEGQVTISTMTGSSPAETKAFTAAWSLRNPSPRTSVSAIKTAPAIVWRLAKKPSTAPSTSTTPTVRAKLTMQVHHCVVVKPTPAMLTTPSPSLTTALLPEELSPSPSVLPPSLPDLHPKGEYPPDLFSVEERRQGWVVLHVFGMMYVFVALAIVCDEYFVPALGVITDKLQISEDVAGATFMAAGGSAPELFTSLIGVFISHSNVGIGTIVGSAVFNILFVIGTCSLFSREILNLTWWPLFRDVSFYILDLIMLILFFLDSLIAWWESLLLLLAYAFYVFTMKWNKHIEVWVKEQLSRRPVAKVMALEDLSKPGDGAIAVDELQDNKKLKLPSLLTRGSSSTSLHNSTIRSTIYQLMLHSLDPLREVRLAKEKEEESLNQGARAQPQAKAESKPEEEEPAKLPAVTVTPAPVPDIKGDQKENPGGQEDVAEAESTGEMPGEEGETAGEGETEEKSGGETQPEGEGETETQGKGEECEDENEAEGKGDNEGEDEGEIHAEDGEMKGNEGETESQELSAENHGEAKNDEKGVEDGGGSDGGDSEEEEEEEEEQEEEEEEEEQEEEEEEEEEEEEKGNEEPLSLDWPETRQKQAIYLFLLPIVFPLWLTVPDVRRQESRKFFVFTFLGSIMWIAMFSYLMVWWAHQVGETIGISEEIMGLTILAAGTSIPDLITSVIVARKGLGDMAVSSSVGSNIFDITVGLPVPWLLFSLINGLQPVPVSSNGLFCAIVLLFLMLLFVISSIASCKWRMNKILGFTMFLLYFVFLIISVMLEDRIISCPVSV

SEQ ID NO: 64218 - protein, 1081 aa, Homo sapiens
MGKLIRMGPQERWLLRTKRLHWSRLLFLLGMLIIGSTYQHLRRPRGLSSLWAAVSSHQPIKLASRDLSSEEMMMMSSSPSKPSSEMGGKMLVPQASVGSDEATLSMTVENIPSMPKRTAKMIPTTTKNNYSPTAAGTERRKEDTPTSSRTLTYYTSTSSRQIVKKYTPTPRGEMKSYSPTQVREKVKYTPSPRGRRVGTYVPSTFMTMETSHAITPRTTVKDSDITATYKILETNSLKRIMEETTPTTLKGMFDSTPTFLTHEVEANVLTSPRSVMEKNNLFPPRRVESNSSAHPWGLVGKSNPKTPQGTVLLHTPATSEGQVTISTMTGSSPAETKAFTAAWSLRNPSPRTSVSAIKTAPAIVWRLAKKPSTAPSTSTTPTVRAKLTMQVHHCVVVKPTPAMLTTPSPSLTTALLPEELSPSPSVLPPSLPDLHPKGEYPPDLFSVEERRQGWVVLHVFGMMYVFVALAIVCDEYFVPALGVITDKLQISEDVAGATFMAAGGSAPELFTSLIGVFISHSNVGIGTIVGSAVFNILFVIGTCSLFSREILNLTWWPLFRDVSFYILDLIMLILFFLDSLIAWWESLLLLLAYAFYVFTMKWNKHIEVWVKEQLSRRPVAKVMALEDLSKLPSLLTRGSSSTSLHNSTIRSTIYQLMLHSLDPLREVRLAKEKEEESLNQGARAQPQAKAESKPEEEEPAKLPAVTVTPAPVPDIKGDQKENPGGQEDVAEAESTGEMPGEEGETAGEGETEEKSGGETQPEGEGETETQGKGEECEDENEAEGKGDNEGEDEGEIHAEDGEMKGNEGETESQELSAENHGEAKNDEKGVEDGGGSDGGDSEEEEEEEEEQEEEEEEEEQEEEEEEEEEEEEKGNEEPLSLDWPETRQKQAIYLFLLPIVFPLWLTVPDVRRQESRKFFVFTFLGSIMWIAMFSYLMVWWAHQVGETIGISEEIMGLTILAAGTSIPDLITSVIVARKGLGDMAVSSSVGSNIFDITVGLPVPWLLFSLINGLQPVPVSSNGLFCAIVLLFLMLLFVISSIASCKWRMNKILGFTMFLLYFVFLIISVMLEDRIISCPVSV

SEQ ID NO: 64219 - protein, 1069 aa, Homo sapiens
MGKLIRMGPQERWLLRTKRLHWSRLLFLLGMLIIGSTYQHLRRPRGLSSLWAAVSSHQPIKLASRDLSSEEMMMMSSSPSKPSSEMGGKMLVPQASVGSDEATLSMTVENIPSMPKRTAKMIPTTTKNNYSPTAAGTERRKEDTPTSSRTLTYYTSTSSRQIVKKYTPTPRGEMKSYSPTQVREKVKYTPSPRGRRVGTYVPSTFMTMETSHAITPRTTVKDSDITATYKILETNSLKRIMEETTPTTLKGMFDSTPTFLTHEVEANVLTSPRSVMEKNNLFPPRRVESNSSAHPWGLVGKSNPKTPQGTVLLHTPATSEGQVTISTMTGSSPAETKAFTAAWSLRNPSPRTSVSAIKTAPAIVWRLAKKPSTAPSTSTTPTVRAKLTMQVHHCVVVKPTPAMLTTPSPSLTTALLPEELSPSPSVLPPSLPDLHPKGEYPPDLFSVEERRQGWVVLHVFGMMYVFVALAIVCDEYFVPALGVITDKLQISEDVAGATFMAAGGSAPELFTSLIGVFISHSNVGIGTIVGSAVFNILFVIGTCSLFSREILNLTWWPLFRDVSFYILDLIMLILFFLDSLIAWWESLLLLLAYAFYVFTMKWNKHIEVWVKEQLSRRPVAKVMALEDLSKPGDGAIAVDELQDNKKLKLPSLLTRGSSSTSLHNSTIRSTIYQLMLHSLDPLREVRLAKEKEEESLNQGARAQPQAKAESKPEEEEPAKLPAVTVTPAPVPDIKGDQKENPGGQEDVAEAESTGEMPGEEGETAGEGETEEKSGGETQPEGEGETETQGKGEECEDENEAEGKGDNEGEDEGEIHAEDGEMKGNEGETESQELSAENHGEAKNDEKGVEDGGGSDGGDSEEEEEEEEEQEEEEEEEEQEEEEEEEEEEEEKGNEEPLSLDWPETRQKQAIYLFLLPIVFPLWLTVPDVRRQVGETIGISEEIMGLTILAAGTSIPDLITSVIVARKGLGDMAVSSSVGSNIFDITVGLPVPWLLFSLINGLQPVPVSSNGLFCAIVLLFLMLLFVISSIASCKWRMNKILGFTMFLLYFVFLIISVMLEDRIISCPVSV

SEQ ID NO: 64220 - protein, 1081 aa, Homo sapiens; identical to SEQ ID NO: 64218

SEQ ID NO: 64221 - protein, 644 aa, Homo sapiens
MDLQQSTTITSLEKWCLDESLSGCRRHYSVKKKLKLIRVLGLFMGLVAISTVSFSISAFSETDTQSTGEASVVSGPRVAQGYHQRTLLDLNDKILDYTPQPPLSKEGESENSTDHAQGDYPKDIFSLEERRKGAIILHVIGMIYMFIALAIVCDEFFVPSLTVITEKLGISDDVAGATFMAAGGSAPELFTSLIGVFIAHSNVGIGTIVGSAVFNILFVIGMCALFSREILNLTWWPLFRDVSFYIVDLIMLIIFFLDNVIMWWESLLLLTAYFCYVVFMKFNVQVEKWVKQMINRNKVVKVTAPEAQAKPSAARDKDEPTLPAKPRLQRGGSSASLHNSLMRNSIFQLMIHTLDPLAEGRFREKASILHKIAKKKCHVDENERQNGAANHVEKIELPNSTSTDVEMTPSSDASEPVQNGNLSHNIEGAEAQTADEEEDQPLSLAWPSETRKQVTFLIVFPIVFPLWITLPDVRKPSSRKFFPITFFGSITWIAVFSYLMVWWAHQVGETIGISEEIMGLTILAAGTSIPDLITSVIVARKGLGDMAVSSSVGSNIFDITVGLPLPWLLYTVIHRFQPVAVSSNGLFCAIVLLFIMLLFVILSIALCKWRMNKILGFIMFGLYFVFLVVSVLLEDRILTCPVSI

SEQ ID NO: 64222 - protein, 661 aa, Homo sapiens
MDLQQSTTITSLEKWCLDESLSGCRRHYSVKKKLKLIRVLGLFMGLVAISTVSFSISAFSETDTQSTGEASVVSGPRVAQGYHQRTLLDLNDKILDYTPQPPLSKEGESENSTDHAQGDYPKDIFSLEERRKGAIILHVIGMIYMFIALAIVCDEFFVPSLTVITEKLGISDDVAGATFMAAGGSAPELFTSLIGVFIAHSNVGIGTIVGSAVFNILFVIGMCALFSREILNLTWWPLFRDVSFYIVDLIMLIIFFLDNVIMWWESLLLLTAYFCYVVFMKFNVQVEKWVKQMINRNKVVKVTAPEAQAKPSAARDKDEPTLPAKPRLQRGGSSASLHNSLMRNSIFQLMIHTLDPLAEELGSYGKLKYYDTMTEEGRFREKASILHKIAKKKCHVDENERQNGAANHVEKIELPNSTSTDVEMTPSSDASEPVQNGNLSHNIEGAEAQTADEEEDQPLSLAWPSETRKQVTFLIVFPIVFPLWITLPDVRKPSSRKFFPITFFGSITWIAVFSYLMVWWAHQVGETIGISEEIMGLTILAAGTSIPDLITSVIVARKGLGDMAVSSSVGSNIFDITVGLPLPWLLYTVIHRFQPVAVSSNGLFCAIVLLFIMLLFVILSIALCKWRMNKILGFIMFGLYFVFLVVSVLLEDRILTCPVSI

SEQ ID NO: 64223 - protein, 644 aa, Homo sapiens
MRPSGDEDRARRRRRRRRRRDLLLSQLCFLASVALLLWSLSSLREQKELDLMDLVGEDRKWMMARKLMQVNDTLTSEDAGLRNSKNCTEPALHEFPNDIFTNEDRRQGAVVLHVLCAIYMFYALAIVCDDFFVPSLEKICERLHLSEDVAGATFMAAGSSAPELFTSVIGVFITKGDVGVGTIVGSAVFNILCIIGVCGLFAGQVVALSSWCLLRDSIYYTLSVIALIVFIYDEKVSWWESLVLVLMYLIYIVIMKYNACIHQCFERRTKGAGNMVNGLANNAEIDDSSNCDATVVLLKKANFHRKASVIMVDELLSAYPHQLSFSEAGLRIMITSHFPPKTRLSMASRMLINERQRLINSRAYTNGESEVAIKIPIKHTVENGTGPSSAPDRGVNGTRRDDVVAEAGNETENENEDNENDEEEEEDEDDDEGPYTPFDTPSGKLETVKWAFTWPLSFVLYFTVPNCNKPRWEKWFMVTFASSTLWIAAFSYMMVWMVTIIGYTLGIPDVIMGITFLAAGTSVPDCMASLIVARQGMGDMAVSNSIGSNVFDILIGLGLPWALQTLAVDYGSYIRLNSRGLIYSVGLLLASVFVTVFGVHLNKWQLDKKLGCGCLLLYGVFLCFSIMTEFNVFTFVNLPMCGDH

SEQ ID NO: 64224 - protein, 584 aa, Homo sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 64225 - protein, 528 aa, Homo sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 64226 - protein, 528 aa, Homo sapiens; identical to SEQ ID NO: 64225

SEQ ID NO: 64227 - protein, 131 aa, Homo sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAIST

SEQ ID NO: 64228 - protein, 231 aa, Homo sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWAL

SEQ ID NO: 64229 - protein, 103 aa, Homo sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLY

SEQ ID NO: 64230 - protein, 584 aa, Homo sapiens; identical to SEQ ID NO: 64224

SEQ ID NO: 64231 - protein, 301 aa, Homo sapiens
MADQPKPISPLKNLLAGGFGGVCLVFVGHPLDTVKVRLQTQPPSLPGQPPMYSGTFDCFRKTLFREGITGLYRGMAAPIIGVTPMFAVCFFGFGLGKKLQQKHPEDVLSYPQLFAAGMLSGVFTTGIMTPGERIKCLLQIQASSGESKYTGTLDCAKKLYQEFGIRGIYKGTVLTLMRDVPASGMYFMTYEWLKNIFTPEGKRVSELSAPRILVAGGIAGIFNWAVAIPPDVLKSRFQTAPPGKYPNGFRDVLRELIRDEGVTSLYKGFNAVMIRAFPANAACFLGFEVAMKFLNWATPNL

SEQ ID NO: 64232 - protein, 251 aa, Homo sapiens
MYSGTFDCFRKTLFREGITGLYRGMAAPIIGVTPMFAVCFFGFGLGKKLQQKHPEDVLSYPQLFAAGMLSGVFTTGIMTPGERIKCLLQIQASSGESKYTGTLDCAKKLYQEFGIRGIYKGTVLTLMRDVPASGMYFMTYEWLKNIFTPEGKRVSELSAPRILVAGGIAGIFNWAVAIPPDVLKSRFQTAPPGKYPNGFRDVLRELIRDEGVTSLYKGFNAVMIRAFPANAACFLGFEVAMKFLNWATPNL

SEQ ID NO: 64233 - protein, 315 aa, Homo sapiens
MTHQDLSITAKLINGGVAGLVGVTCVFPIDLAKTRLQNQHGKAMYKGMIDCLMKTARAEGFFGMYRGAAVNLTLVTPEKAIKLAANDFFRRLLMEDGMQRNLKMEMLAGCGAGMCQVVVTCPMEMLKIQLQDAGRLAVHHQGSASAPSTSRSYTTGSASTHRRPSATLIAWELLRTQGLAGLYRGLGATLLRDIPFSIIYFPLFANLNNLGFNELAGKASFAHSFVSGCVAGSIAAVAVTPLDVLKTRIQTLKKGLGEDMYSGITDCARKLWIQEGPSAFMKGAGCRALVIAPLFGIAQGVYFIGIGERILKCFD

SEQ ID NO: 64234 - protein, 315 aa, Homo sapiens; identical to SEQ ID NO: 64233

SEQ ID NO: 64235 - protein, 571 aa, Homo sapiens
MENVKEIFGQTIIHHHIPFNWDCEFIRLHFGHNRKKHLNYTEFTQFLQELQLEHARQAFALKDKSKSGMISGLDFSDIMVTIRSHMLTPFVEENLVSAAGGSISHQVSFSYFNAFNSLLNNMELVRKIYSTLAGTRKDVEVTKEEFAQSAIRYGQVTPLEIDILYQLADLYNASGRLTLADIERIAPLAEGALPYNLAELQRQQSPGLGRPIWLQIAESAYRFTLGSVAGAVGATAVYPIDLVKTRMQNQRGSGSVVGELMYKNSFDCFKKVLRYEGFFGLYRGLIPQLIGVAPEKAIKLTVNDFVRDKFTRRDGSVPLPAEVLAGGCAGGSQVIFTNPLEIVKIRLQVAGEITTGPRVSALNVLRDLGIFGLYKGAKACFLRDIPFSAIYFPVYAHCKLLLADENGHVGGLNLLAAGAMAGVPAASLVTPADVIKTRLQVAARAGQTTYSGVIDCFRKILREEGPSAFWKGTAARVFRSSPQFGVTLVTYELLQRWFYIDFGGLKPAGSEPTPKSRIADLPPANPDHIGGYRLATATFAGIENKFGLYLPKFKSPSVAVVQPKAAVAATQ

SEQ ID NO: 64236 - protein, 678 aa, Homo sapiens
MAVKVQTTKRGDPHELRNIFLQYASTEVDGERYMTPEDFVQRYLGLYNDPNSNPKIVQLLAGVADQTKDGLISYQEFLAFESVLCAPDSMFIVAFQLFDKSGNGEVTFENVKEIFGQTIIHHHIPFNWDCEFIRLHFGHNRKKHLNYTEFTQFLQELQLEHARQAFALKDKSKSGMISGLDFSDIMVTIRSHMLTPFVEENLVSAAGGSISHQVSFSYFNAFNSLLNNMELVRKIYSTLAGTRKDVEVTKEEFAQSAIRYGQVTPLEIDILYQLADLYNASGRLTLADIERIAPLAEGALPYNLAELQRQQSPGLGRPIWLQIAESAYRFTLGSVAGAVGATAVYPIDLVKTRMQNQRGSGSVVGELMYKNSFDCFKKVLRYEGFFGLYRGLIPQLIGVAPEKAIKLTVNDFVRDKFTRRDGSVPLPAEVLAGGCAGGSQVIFTNPLEIVKIRLQVAGEITTGPRVSALNVLRDLGIFGLYKGAKACFLRDIPFSAIYFPVYAHCKLLLADENGHVGGLNLLAAGAMAGVPAASLVTPADVIKTRLQVAARAGQTTYSGVIDCFRKILREEGPSAFWKGTAARVFRSSPQFGVTLVTYELLQRWFYIDFGGLKPAGSEPTPKSRIADLPPANPDHIGGYRLATATFAGIENKFGLYLPKFKSPSVAVVQPKAAVAATQ

SEQ ID NO: 64237 - protein, 325 aa, Homo sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 64238 - protein, 353 aa, Homo sapiens
MGIFPGIILIFLRVKFATAAVIHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRCLCSKAVTGCVLWLMPVIPALWEANAGGSLEGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 64239 - protein, 322 aa, Homo sapiens
MGIFPGIILIFLRVKFATAAVIHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 64240 - protein, 198 aa, Homo sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWR

SEQ ID NO: 64241 - protein, 205 aa, Homo sapiens
MSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFV

SEQ ID NO: 64242 - protein, 240 aa, Homo sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFV

SEQ ID NO: 64243 - protein, 323 aa, Homo sapiens
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEMLKIQLQDAGRIAAQRKILAAQGQLSAQGGAQPSVEAPAAPRPTATQLTRDLLRSRGIAGLYKGLGATLLRDVPFSVVYFPLFANLNQLGRPASEEKSPFYVSFLAGCVAGSAAAVAVNPCDVVKTRLQSLQRGVNEDTYSGILDCARKILRHEGPSAFLKGAYCRALVIAPLFGIAQVVYFLGIAESLLGLLQDPQA

SEQ ID NO: 64244 - protein, 110 aa, Homo sapiens
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAG

SEQ ID NO: 64245 - protein, 127 aa, Homo sapiens
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEML

SEQ ID NO: 64246 - protein, 119 aa, Homo sapiens
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVI

SEQ ID NO: 64247 - protein, 123 aa, Homo sapiens
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTP

SEQ ID NO: 64248 - protein, 113 aa, Homo sapiens
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGA

SEQ ID NO: 64249 - protein, 78 aa, Homo sapiens
MADKQISLPAKLINGGIAGLIGVTCVFPIDLAKTRLQNQQNGQRVYTSMSDCLIKTVRSEGYFGMYRGAAVNLTLVTP

SEQ ID NO: 64250 - protein, 59 aa, Homo sapiens
MADKQISLPAKLINGGIAGLIGVTCVFPIDLAKTRLQNQQNGQRVYTSMSDCLIKTVRS

SEQ ID NO: 64251 - protein, 323 aa, Homo sapiens; identical to SEQ ID NO: 64243

SEQ ID NO: 64252 - protein, 114 aa, Homo sapiens
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAG

SEQ ID NO: 64253 - protein, 78 aa, Homo sapiens; identical to SEQ ID NO: 64249

SEQ ID NO: 64254 - protein, 106 aa, Homo sapiens
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKE

SEQ ID NO: 64255 - protein, 135 aa, Homo sapiens
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEMLKIQLQDAG

SEQ ID NO: 64256 - protein, 315 aa, Homo sapiens
MHREPAKKKAEKRLFDASSFGKDLLAGGVAAAVSKTAVAPIERVKLLLQVQASSKQISPEARYKGMVDCLVRIPREQGFFSFWRGNLANVIRYFPTQALNFAFKDKYKQLFMSGVNKEKQFWRWFLANLASGGAAGATSLCVVYPLDFARTRLGVDIGKGPEERQFKGLGDCIMKIAKSDGIAGLYQGFGVSVQGIIVYRASYFGAYDTVKGLLPKPKKTPFLVSFFIAQVVTTCSGILSYPFDTVRRRMMMQSGEAKRQYKGTLDCFVKIYQHEGISSFFRGAFSNVLRGTGGALVLVLYDKIKEFFHIDIGGR

SEQ ID NO: 64257 - protein, 298 aa, Homo sapiens
MGDHAWSFLKDFLAGGVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKGMLPDPKNVHIFVSWMIAQSVTAVAGLVSYPFDTVRRRMMMQSGRKGADIMYTGTVDCWRKIAKDEGAKAFFKGAWSNVLRGMGGAFVLVLYDEIKKYV

SEQ ID NO: 64258 - protein, 298 aa, Homo sapiens
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFWLYFAGNLASGGAAGATSLCFVYPLDFARTRLAADVGKAGAEREFRGLGDCLVKIYKSDGIKGLYQGFNVSVQGIIIYRAAYFGIYDTAKGMLPDPKNTHIVISWMIAQTVTAVAGLTSYPFDTVRRRMMMQSGRKGTDIMYTGTLDCWRKIARDEGGKAFFKGAWSNVLRGMGGAFVLVLYDEIKKYT

SEQ ID NO: 64259 - protein, 298 aa, Homo sapiens
MTEQAISFAKDFLAGGIAAAISKTAVAPIERVKLLLQVQHASKQIAADKQYKGIVDCIVRIPKEQGVLSFWRGNLANVIRYFPTQALNFAFKDKYKQIFLGGVDKHTQFWRYFAGNLASGGAAGATSLCFVYPLDFARTRLAADVGKSGTEREFRGLGDCLVKITKSDGIRGLYQGFSVSVQGIIIYRAAYFGVYDTAKGMLPDPKNTHIVVSWMIAQTVTAVAGVVSYPFDTVRRRMMMQSGRKGADIMYTGTVDCWRKIFRDEGGKAFFKGAWSNVLRGMGGAFVLVLYDELKKVI

SEQ ID NO: 64260 - protein, 158 aa, Homo sapiens
MTEQAISFAKDFLAGGIAAAISKTAVAPIERVKLLLQVQHASKQIAADKQYKGIVDCIVRIPKEQGVLSFWRGNLANVIRYFPTQALNFAFKDKYKQIFLGGVDKHTQFWRYFAGNLASGGAAGATSLCFVYPLDFARTRLAADVGKSGTEREFRGLG

SEQ ID NO: 64261 - protein, 311 aa, Homo sapiens
MPAPRAPRALAAAAPASGKAKLTHPGKAILAGGLAGGIEICITFPTEYVKTQLQLDERSHPPRYRGIGDCVRQTVRSHGVLGLYRGLSSLLYGSIPKAAVRFGMFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQGLEAHKYRNTWDCGLQILKKEGLKAFYKGTVPRLGRVCLDVAIVFVIYDEVVKLLNKVWKTD

SEQ ID NO: 64262 - protein, 208 aa, Homo sapiens
MFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQGLEAHKYRNTWDCGLQILKKEGLKAFYKGTVPRLGRVCLDVAIVFVIYDEVVKLLNKVWKTD

SEQ ID NO: 64263 - protein, 332 aa, Homo sapiens
MAAATAAAALAAADPPPAMPQAAGAGGPTTRRDFYWLRSFLAGGIAGCCAKTTVAPLDRVKVLLQAHNHHYKHLGVFSALRAVPQKEGFLGLYKGNGAMMIRIFPYGAIQFMAFEHYKTLITTKLGISGHVHRLMAGSMAGMTAVICTYPLDMVRVRLAFQVKGEHSYTGIIHAFKTIYAKEGGFFGFYRGLMPTILGMAPYAGVSFFTFGTLKSVGLSHAPTLLGRPSSDNPNVLVLKTHVNLLCGGVAGAIAQTISYPFDVTRRRMQLGTVLPEFEKCLTMRDTMKYVYGHHGIRKGLYRGLSLNYIRCIPSQAVAFTTYELMKQFFHLN

SEQ ID NO: 64264 - protein, 234 aa, Homo sapiens
MMIRIFPYGAIQFMAFEHYKTLITTKLGISGHVHRLMAGSMAGMTAVICTYPLDMVRVRLAFQVKGEHSYTGIIHAFKTIYAKEGGFFGFYRGLMPTILGMAPYAGVSFFTFGTLKSVGLSHAPTLLGRPSSDNPNVLVLKTHVNLLCGGVAGAIAQTISYPFDVTRRRMQLGTVLPEFEKCLTMRDTMKYVYGHHGIRKGLYRGLSLNYIRCIPSQAVAFTTYELMKQFFHLN

SEQ ID NO: 64265 - protein, 301 aa, Homo sapiens
MKSNPAIQAAIDLTAGAAGGTACVLTGQPFDTMKVKMQTFPDLYRGLTDCCLKTYSQVGFRGFYKGTSPALIANIAENSVLFMCYGFCQQVVRKVAGLDKQAKLSDLQNAAAGSFASAFAALVLCPTELVKCRLQTMYEMETSGKIAKSQNTVWSVIKSILRKDGPLGFYHGLSSTLLREVPGYFFFFGGYELSRSFFASGRSKDELGPVPLMLSGGVGGICLWLAVYPVDCIKSRIQVLSMSGKQAGFIRTFINVVKNEGITALYSGLKPTMIRAFPANGALFLAYEYSRKLMMNQLEAY

SEQ ID NO: 64266 - protein, 133 aa, Homo sapiens
MKSNPAIQAAIDLTAGAAGGTACVLTGQPFDTMKVKMQTFPDLYRGLTDCCLKTYSQVGFRGFYKGTSPALIANIAENSVLFMCYGFCQQVVRKVAGLDKQAKLSTVWSVIKSILRKDGPLGFYHGLSSTLLR

SEQ ID NO: 64267 - protein, 133 aa, Homo sapiens; identical to SEQ ID NO: 64266

SEQ ID NO: 64268 - protein, 301 aa, Homo sapiens; identical to SEQ ID NO: 64265

SEQ ID NO: 64269 - protein, 241 aa, Homo sapiens
MKSNPAIQAAIDLTAGAAGGTACVLTGQPFDTMKVAGLDKQAKLSDLQNAAAGSFASAFAALVLCPTELVKCRLQTMYEMETSGKIAKSQNTVWSVIKSILRKDGPLGFYHGLSSTLLREVPGYFFFFGGYELSRSFFASGRSKDELGPVPLMLSGGVGGICLWLAVYPVDCIKSRIQVLSMSGKQAGFIRTFINVVKNEGITALYSGLKPTMIRAFPANGALFLAYEYSRKLMMNQLEAY

SEQ ID NO: 64270 - protein, 301 aa, Homo sapiens
MKSGPGIQAAIDLTAGAAGGTACVLTGQPFDTIKVKMQTFPDLYKGLTDCFLKTYAQVGLRGFYKGTGPALMAYVAENSVLFMCYGFCQQFVRKVAGMDKQAKLSDLQTAAAGSFASAFAALALCPTELVKCRLQTMYEMEMSGKIAKSHNTIWSVVKGILKKDGPLGFYHGLSSTLLQEVPGYFFFFGGYELSRSFFASGRSKDELGPVHLMLSGGVAGICLWLVVFPVDCIKSRIQVLSMYGKQAGFIGTLLSVVRNEGIVALYSGLKATMIRAIPANGALFVAYEYSRKMMMKQLEAY

SEQ ID NO: 64271 - protein, 314 aa, Homo sapiens
MAATASAGAGGIDGKPRTSPKSVKFLFGGLAGMGATVFVQPLDLVKNRMQLSGEGAKTREYKTSFHALTSILKAEGLRGIYTGLSAGLLRQATYTTTRLGIYTVLFERLTGADGTPPGFLLKAVIGMTAGATGAFVGTPAEVALIRMTADGRLPADQRRGYKNVFNALIRITREEGVLTLWRGCIPTMARAVVVNAAQLASYSQSKQFLLDSGYFSDNILCHFCASMISGLVTTAASMPVDIAKTRIQNMRMIDGKPEYKNGLDVLFKVVRYEGFFSLWKGFTPYYARLGPHTVLTFIFLEQMNKAYKRLFLSG

SEQ ID NO: 64272 - protein, 263 aa, Homo sapiens
MAATASAGAGGIDGKPRTSPKSVKFLFGGLAGLSAGLLRQATYTTTRLGIYTVLFERLTGADGTPPGFLLKAVIGMTAGATGAFVGTPAEVALIRMTADGRLPADQRRGYKNVFNALIRITREEGVLTLWRGCIPTMARAVVVNAAQLASYSQSKQFLLDSGYFSDNILCHFCASMISGLVTTAASMPVDIAKTRIQNMRMIDGKPEYKNGLDVLFKVVRYEGFFSLWKGFTPYYARLGPHTVLTFIFLEQMNKAYKRLFLSG

SEQ ID NO: 64273 - protein, 225 aa, Homo sapiens
MEYWYVALKQQSLKADILPSLFLSIFLVKGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 64274 - protein, 92 aa, Homo sapiens
MGSVTAMTVFFPLDTARLRLQVDEKRKSKTTHMVLLEIIKEEGLLAPYRGWFPVISSLCCSNFVYFYTFNSLKALWVKGQHSTTGKDLVVGF

SEQ ID NO: 64275 - protein, 307 aa, Homo sapiens
MASVLSYESLVHAVAGAVGSVTAMTVFFPLDTARLRLQVDEKRKSKTTHMVLLEIIKEEGLLAPYRGWFPVISSLCCSNFVYFYTFNSLKALWVKGQHSTTGKDLVVGFVAGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 64276 - protein, 234 aa, Homo sapiens
MASVLSYESLVHAVAGAVGSVTAMTVFFPLDTARLRLQGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 64277 - protein, 270 aa, Homo sapiens
MIDEKRKSKTTHMVLLEIIKEEGLLAPYRGWFPVISSLCCSNFVYFYTFNSLKALWVKGQHSTTGKDLVVGFVAGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 64278 - protein, 361 aa, Homo sapiens
MFSSVAHLARANPFNTPHLQLVHDGLGDLRSSSPGPTGQPRRPRNLAAAAVEEYSCEFGSAKYYALCGFGGVLSCGLTHTAVVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 64279 - protein, 362 aa, Homo sapiens
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 64280 - protein, 361 aa, Homo sapiens; identical to SEQ ID NO: 64278

SEQ ID NO: 64281 - protein, 361 aa, Homo sapiens; identical to SEQ ID NO: 64278

SEQ ID NO: 64282 - protein, 362 aa, Homo sapiens; identical to SEQ ID NO: 64279

SEQ ID NO: 64283 - protein, 361 aa, Homo sapiens; identical to SEQ ID NO: 64278

SEQ ID NO: 64284 - protein, 298 aa, Homo sapiens
MSAKPEVSLVREASRQIVAGGSAGLVEICLMHPLDVVKTRFQIQRCATDPNSYKSLVDSFRMIFQMEGLFGFYKGILPPILAETPKRAVKFFTFEQYKKLLGYVSLSPALTFAIAGLGSGLTEAIVVNPFEVVKVGLQANRNTFAEQPSTVGYARQIIKKEGWGLQGLNKGLTATLGRHGVFNMVYFGFYYNVKNMIPVNKDPILEFWRKFGIGLLSGTIASVINIPFDVAKSRIQGPQPVPGEIKYRTCFKTMATVYQEEGILALYKGLLPKIMRLGPGGAVMLLVYEYTYSWLQEN

SEQ ID NO: 64285 - protein, 299 aa, Homo sapiens
MSAKPEVSLVREASRQIVAGGSAGLVEICLMHPLDVVKTRFQIQRCATDPNSYKSLVDSFRMIFQMEGLFGFYKGILPPILAETPKRAVKFFTFEQYKKLLGYVSLSPALTFAIAGLGSGLTEAIVVNPFEVVKVGLQANRNTFAEQPSTVGYARQIIKKEGWGLQGLNKGLTATLGRHGVFNMVYFGFYYNVKNMIPVNKDPILEFWRKFGIGLLSGTIASVINIPFDVAKSRIQGPQPVPGEIKYRTCFKTMATVYQEEGILALYKGLLPKIMRLGPGGAVMLLVYEYTYSWLQENW

SEQ ID NO: 64286 - protein, 320 aa, Homo sapiens
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTELVHRGSVYDAREFSVHFVCGGLAACMATLTVHPVDVLRTRFAAQGEPKVYNTLRHAVGTMYRSEGPQVFYKGLAPTLIAIFPYAGLQFSCYSSLKHLYKWAIPAEGKKNENLQNLLCGSGAGVISKTLTYPLDLFKKRLQVGGFEHARAAFGQVRRYKGLMDCAKQVLQKEGALGFFKGLSPSLLKAALSTGFMFFSYEFFCNVFHCMNRTASQR

SEQ ID NO: 64287 - protein, 320 aa, Homo sapiens; identical to SEQ ID NO: 64286

SEQ ID NO: 64288 - protein, 263 aa, Homo sapiens
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQVYNTLRHAVGTMYRSEGPQVFYKGLAPTLIAIFPYAGLQFSCYSSLKHLYKWAIPAEGKKNENLQNLLCGSGAGVISKTLTYPLDLFKKRLQVGGFEHARAAFGQVRRYKGLMDCAKQVLQKEGALGFFKGLSPSLLKAALSTGFMFFSYEFFCNVFHCMNRTASQR

SEQ ID NO: 64289 - protein, 320 aa, Homo sapiens; identical to SEQ ID NO: 64286

SEQ ID NO: 64290 - protein, 320 aa, Homo sapiens; identical to SEQ ID NO: 64286

SEQ ID NO: 64291 - protein, 320 aa, Homo sapiens; identical to SEQ ID NO: 64286

SEQ ID NO: 64292 - protein, 675 aa, Homo sapiens
MAAAKVALTKRADPAELRTIFLKYASIEKNGEFFMSPNDFVTRYLNIFGESQPNPKTVELLSGVVDQTKDGLISFQEFVAFESVLCAPDALFMVAFQLFDKAGKGEVTFEDVKQVFGQTTIHQHIPFNWDSEFVQLHFGKERKRHLTYAEFTQFLLEIQLEHAKQAFVQRDNARTGRVTAIDFRDIMVTIRPHVLTPFVEECLVAAAGGTTSHQVSFSYFNGFNSLLNNMELIRKIYSTLAGTRKDVEVTKEEFVLAAQKFGQVTPMEVDILFQLADLYEPRGRMTLADIERIAPLEEGTLPFNLAEAQRQKASGDSARPVLLQVAESAYRFGLGSVAGAVGATAVYPIDLVKTRMQNQRSTGSFVGELMYKNSFDCFKKVLRYEGFFGLYRGLLPQLLGVAPEKAIKLTVNDFVRDKFMHKDGSVPLAAEILAGGCAGGSQVIFTNPLEIVKIRLQVAGEITTGPRVSALSVVRDLGFFGIYKGAKACFLRDIPFSAIYFPCYAHVKASFANEDGQVSPGSLLLAGAIAGMPAASLVTPADVIKTRLQVAARAGQTTYSGVIDCFRKILREEGPKALWKGAGARVFRSSPQFGVTLLTYELLQRWFYIDFGGVKPMGSEPVPKSRINLPAPNPDHVGGYKLAVATFAGIENKFGLYLPLFKPSVSTSKAIGGGP

SEQ ID NO: 64293 - protein, 676 aa, Homo sapiens
MAAAKVALTKRADPAELRTIFLKYASIEKNGEFFMSPNDFVTRYLNIFGESQPNPKTVELLSGVVDQTKDGLISFQEFVAFESVLCAPDALFMVAFQLFDKAGKGEVTFEDVKQVFGQTTIHQHIPFNWDSEFVQLHFGKERKRHLTYAEFTQFLLEIQLEHAKQAFVQRDNARTGRVTAIDFRDIMVTIRPHVLTPFVEECLVAAAGGTTSHQVSFSYFNGFNSLLNNMELIRKIYSTLAGTRKDVEVTKEEFVLAAQKFGQVTPMEVDILFQLADLYEPRGRMTLADIERIAPLEEGTLPFNLAEAQRQQKASGDSARPVLLQVAESAYRFGLGSVAGAVGATAVYPIDLVKTRMQNQRSTGSFVGELMYKNSFDCFKKVLRYEGFFGLYRGLLPQLLGVAPEKAIKLTVNDFVRDKFMHKDGSVPLAAEILAGGCAGGSQVIFTNPLEIVKIRLQVAGEITTGPRVSALSVVRDLGFFGIYKGAKACFLRDIPFSAIYFPCYAHVKASFANEDGQVSPGSLLLAGAIAGMPAASLVTPADVIKTRLQVAARAGQTTYSGVIDCFRKILREEGPKALWKGAGARVFRSSPQFGVTLLTYELLQRWFYIDFGGVKPMGSEPVPKSRINLPAPNPDHVGGYKLAVATFAGIENKFGLYLPLFKPSVSTSKAIGGGP

SEQ ID NO: 64294 - protein, 567 aa, Homo sapiens
MEDVKQVFGQTTIHQHIPFNWDSEFVQLHFGKERKRHLTYAEFTQFLLEIQLEHAKQAFVQRDNARTGRVTAIDFRDIMVTIRPHVLTPFVEECLVAAAGGTTSHQVSFSYFNGFNSLLNNMELIRKIYSTLAGTRKDVEVTKEEFVLAAQKFGQVTPMEVDILFQLADLYEPRGRMTLADIERIAPLEEGTLPFNLAEAQRQKASGDSARPVLLQVAESAYRFGLGSVAGAVGATAVYPIDLVKTRMQNQRSTGSFVGELMYKNSFDCFKKVLRYEGFFGLYRGLLPQLLGVAPEKAIKLTVNDFVRDKFMHKDGSVPLAAEILAGGCAGGSQVIFTNPLEIVKIRLQVAGEITTGPRVSALSVVRDLGFFGIYKGAKACFLRDIPFSAIYFPCYAHVKASFANEDGQVSPGSLLLAGAIAGMPAASLVTPADVIKTRLQVAARAGQTTYSGVIDCFRKILREEGPKALWKGAGARVFRSSPQFGVTLLTYELLQRWFYIDFGGVKPMGSEPVPKSRINLPAPNPDHVGGYKLAVATFAGIENKFGLYLPLFKPSVSTSKAIGGGP

SEQ ID NO: 64295 - protein, 186 aa, Homo sapiens
MKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRITLAKAGSSTADGNVLSVLHGVWRSQGLAGLFAGVFPRMAAISLGGFIFLGAYDRTHSLLLEVGRKSP

SEQ ID NO: 64296 - protein, 274 aa, Homo sapiens
MDRPGFVAALVAGGVAGVSVDLILFPLDTIKTRLQSPQGFSKAGGFHGIYAGVPSAAIGSFPNAAAFFITYEYVKWFLHADSSSYLTPMKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRITLAKAGSSTADGNVLSVLHGVWRSQGLAGLFAGVFPRMAAISLGGFIFLGAYDRTHSLLLEVGRKSP

SEQ ID NO: 64297 - protein, 21 aa, Homo sapiens
MDRPGFVAALVLLHFLSPMNM

SEQ ID NO: 64298 - protein, 158 aa, Homo sapiens
MEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRMAAVIVNSSRSQLKV

SEQ ID NO: 64299 - protein, 323 aa, Homo sapiens
MSVPEEEERLLPLTQRWPRASKFLLSGCAATVAELATFPLDLTKTRLQMQGEAALARLGDGARESAPYRGMVRTALGIIEEEGFLKLWQGVTPAIYRHVVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRMTPWSMVFWLTYEKIREMSGVSPF

SEQ ID NO: 64300 - protein, 245 aa, Homo sapiens
MSVPEEEERLLPLTQRWPRASKFLLSGCAATVAELATFPLDLTKTRLQMQGEAALARLGDGARESAPYRGMVRTALGIIEEEGFLKLWQGVTPAIYRHVVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLVLNTPLEDNIMTHGLSSDLVGSHKAIQ

SEQ ID NO: 64301 - protein, 98 aa, Homo sapiens
  MOD_RES (1)..(1): Any amino acid
XNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRM

SEQ ID NO: 64302 - protein, 149 aa, Homo sapiens
MSECPLILYIHKHIDTYSQSYLFNDLFYPVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLV

SEQ ID NO: 64303 - protein, 159 aa, Homo sapiens
  MOD_RES (1)..(1): Any amino acid
XMEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRMAAVIVNSSRSQLKV

SEQ ID NO: 64304 - protein, 237 aa, Homo sapiens
MYLYLMKMPAAYQVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRMTPWSMVFWLTYEKIREMSGVSPF

SEQ ID NO: 64305 - protein, 364 aa, Homo sapiens
MELEGRGAGGVAGGPAAGPGRSPGESALLDGWLQRGVGRGAGGGEAGACRPPVRQDPDSGPDYEALPAGATVTTHMVAGAVAGILEHCVMYPIDCVKTRMQSLQPDPAARYRNVLEALWRIIRTEGLWRPMRGLNVTATGAGPAHALYFACYEKLKKTLSDVIHPGGNSHIANGAAGCVATLLHDAAMNPAEVVKQRMQMYNSPYHRVTDCVRAVWQNEGAGAFYRSYTTQLTMNVPFQAIHFMTYEFLQEHFNPQRRYNPSSHVLSGACAGAVAAAATTPLDVCKTLLNTQESLALNSHITGHITGMASAFRTVYQVGGVTAYFRGVQARVIYQIPSTAIAWSVYEFFKYLITKRQEEWRAGK

SEQ ID NO: 64306 - protein, 225 aa, Homo sapiens
RGAAGWSHCHHAHGGRRRGRDPGALRDVPHRLRQGAAGCVATLLHDAAMNPAEVVKQRMQMYNSPYHRVTDCVRAVWQNEGAGAFYRSYTTQLTMNVPFQAIHFMTYEFLQEHFNPQRRYNPSSHVLSGACAGAVAAAATTPLDVCKTLLNTQESLALNSHITGHITGMASAFRTVYQVGGVTAYFRGVQARVIYQIPSTAIAWSVYEFFKYLITKRQEEWRAGK

SEQ ID NO: 64307 - protein, 291 aa, Homo sapiens
MSALNWKPFVYGGLASITAECGTFPIDLTKTRLQIQGQTNDAKFKEIRYRGMLHALVRIGREEGLKALYSGIAPAMLRQASYGTIKIGTYQSLKRLFIERPEDETLPINVICGILSGVISSTIANPTDVLKIRMQAQSNTIQGGMIGNFMNIYQQEGTRGLWKGVSLTAQRAAIVVGVELPVYDITKKHLILSGLMGDTVYTHFLSSFTCGLAGALASNPVDVVRTRMMNQRVLRDGRCSGYTGTLDCLLQTWKNEGFFALYKGFWPNWLRLGPWNIIFFVTYEQLKKLDL

SEQ ID NO: 64308 - protein, 216 aa, Homo sapiens
MLRQASYGTIKIGTYQSLKRLFIERPEDETLPINVICGILSGVISSTIANPTDVLKIRMQAQSNTIQGGMIGNFMNIYQQEGTRGLWKGVSLTAQRAAIVVGVELPVYDITKKHLILSGLMGDTVYTHFLSSFTCGLAGALASNPVDVVRTRMMNQRVLRDGRCSGYTGTLDCLLQTWKNEGFFALYKGFWPNWLRLGPWNIIFFVTYEQLKKLDL

SEQ ID NO: 64309 - protein, 240 aa, Homo sapiens
MLHALVRIGREEGLKALYSGIAPAMLRQASYGTIKIGTYQSLKRLFIERPEDETLPINVICGILSGVISSTIANPTDVLKIRMQAQSNTIQGGMIGNFMNIYQQEGTRGLWKGVSLTAQRAAIVVGVELPVYDITKKHLILSGLMGDTVYTHFLSSFTCGLAGALASNPVDVVRTRMMNQRVLRDGRCSGYTGTLDCLLQTWKNEGFFALYKGFWPNWLRLGPWNIIFFVTYEQLKKLDL

SEQ ID NO: 64310 - protein, 315 aa, Homo sapiens
MTGQGQSASGSSAWSTVFRHVRYENLIAGVSGGVLSNLALHPLDLVKIRFAVSDGLELRPKYNGILHCLTTIWKLDGLRGLYQGVTPNIWGAGLSWGLYFFFYNAIKSYKTEGRAERLEATEYLVSAAEAGAMTLCITNPLWVTKTRLMLQYDAVVNSPHRQYKGMFDTLVKIYKYEGVRGLYKGFVPGLFGTSHGALQFMAYELLKLKYNQHINRLPEAQLSTVEYISVAALSKIFAVAATYPYQVVRARLQDQHMFYSGVIDVITKTWRKEGVGGFYKGIAPNLIRVTPACCITFVVYENVSHFLLDLREKRK

SEQ ID NO: 64311 - protein, 299 aa, Homo sapiens
MTGQGQSASGSSAWSGGVLSNLALHPLDLVKIRFAVSDGLELRPKYNGILHCLTTIWKLDGLRGLYQGVTPNIWGAGLSWGLYFFFYNAIKSYKTEGRAERLEATEYLVSAAEAGAMTLCITNPLWVTKTRLMLQYDAVVNSPHRQYKGMFDTLVKIYKYEGVRGLYKGFVPGLFGTSHGALQFMAYELLKLKYNQHINRLPEAQLSTVEYISVAALSKIFAVAATYPYQVVRARLQDQHMFYSGVIDVITKTWRKEGVGGFYKGIAPNLIRVTPACCITFVVYENVSHFLLDLREKRK

SEQ ID NO: 64312 - protein, 183 aa, Homo sapiens
MTLCITNPLWVTKTRLMLQYDAVVNSPHRQYKGMFDTLVKIYKYEGVRGLYKGFVPGLFGTSHGALQFMAYELLKLKYNQHINRLPEAQLSTVEYISVAALSKIFAVAATYPYQVVRARLQDQHMFYSGVIDVITKTWRKEGVGGFYKGIAPNLIRVTPACCITFVVYENVSHFLLDLREKRK

SEQ ID NO: 64313 - protein, 321 aa, Homo sapiens
MATGGQQKENTLLHLFAGGCGGTVGAIFTCPLEVIKTRLQSSRLALRTVYYPQVHLGTISGAGMVRPTSVTPGLFQVLKSILEKEGPKSLFRGLGPNLVGVAPSRAVYFACYSKAKEQFNGIFVPNSNIVHIFSAGSAAFITNSLMNPIWMVKTRMQLEQKVRGSKQMNTLQCARYVYQTEGIRGFYRGLTASYAGISETIICFAIYESLKKYLKEAPLASSANGTEKNSTSFFGLMAAAALSKGCASCIAYPHEVIRTRLREEGTKYKSFVQTARLVFREEGYLAFYRGLFAQLIRQIPNTAIVLSTYELIVYLLEDRTQ

SEQ ID NO: 64314 - protein, 304 aa, Homo sapiens
METVPPAVDLVLGASACCLACVFTNPLEVVKTRLQLQGELQARGTYPRPYHGFIASVAAVARADGLWGLQKGLAAGLLYQGLMNGVRFYCYSLACQAGLTQQPGGTVVAGAVAGALGAFVGSPAYLIKTQLQAQTVAAVAVGHQHNHQTVLGALETIWRQQGLLGLWQGVGGAVPRVMVGSAAQLATFASAKAWVQKQQWLPEDSWLVALAGGMISSIAVVVVMTPFDVVSTRLYNQPVDTAGRGQLYGGLTDCMVKIWRQEGPLALYKGLGPAYLRLGPHTILSMLFWDELRKLAGRAQHKGT

SEQ ID NO: 64315 - protein, 295 aa, Homo sapiens
MDFLMSGLAACGACVFTNPLEVVKTRMQLQGELQAPGTYQRHYRNVFHAFITIGKVDGLAALQKGLAPALLYQFLMNGIRLGTYGLAEAGGYLHTAEGTHSPARSAAAGAMAGVMGAYLGSPIYMVKTHLQAQAASEIAVGHQYKHQGMFQALTEIGQKHGLVGLWRGALGGLPRVIVGSSTQLCTFSSTKDLLSQWEIFPPQSWKLALVAAMMSGIAVVLAMAPFDVACTRLYNQPTDAQGKNRVPKFSATSCSASAPLLGTKDVRIVKGQTGHQLFKVTQAPGCSPILLGTQS

SEQ ID NO: 64316 - protein, 291 aa, Homo sapiens
MDFLMSGLAACGACVFTNPLEVVKTRMQLQGELQAPGTYQRHYRNVFHAFITIGKVDGLAALQKGLAPALLYQFLMNGIRLGTYGLAEAGGYLHTAEGTHSPARSAAAGAMAGVMGAYLGSPIYMVKTHLQAQAASEIAVGHQYKHQGMFQALTEIGQKHGLVGLWRGALGGLPRVIVGSSTQLCTFSSTKDLLSQWEIFPPQSWKLALVAAMMSGIAVVLAMAPFDVACTRLYNQPTDAQGKGLMYRGILDALLQTARTEGIFGMYKEPSPQVLSNIMQCFSAFTGDQRC

SEQ ID NO: 64317 - protein, 304 aa, Homo sapiens
MIQNSRPSLLQPQDVGDTVETLMLHPVIKAFLCGSISGTCSTLLFQPLDLLKTRLQTLQPSDHGSRRVGMLAVLLKVVRTESLLGLWKGMSPSIVRCVPGVGIYFGTLYSLKQYFLRGHPPTALESVMLGVGSRSVAGVCMSPITVIKTRYESGKYGYESIYAALRSIYHSEGHRGLFSGLTATLLRDAPFSGIYLMFYNQTKNIVPHDQVDATLIPITNFSCGIFAGILASLVTQPADVIKTHMQLYPLKFQWIGQAVTLIFKDYGLRGFFQGGIPRALRRTLMAAMAWTVYEEMMAKMGLKS

SEQ ID NO: 64318 - protein, 351 aa, Homo sapiens
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSALYWFNYELVKSWLNGFRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 64319 - protein, 359 aa, Homo sapiens
MADQDPAGISPLQQMVASGTGAVVTSLFMTPLDVVKVRLQSQRPSMASELMPSSRLWSLSYTKLPSSLQSTGKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSALYWFNYELVKSWLNGFRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 64320 - protein, 336 aa, Homo sapiens
MADQDPAGISPLQQMVASGTGAVVTSLFMTPLDVVKVRLQSQRPSMASGKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSALYWFNYELVKSWLNGFRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 64321 - protein, 338 aa, Homo sapiens
MDPETRGQEIIKVTPLQQMLASCTGAILTSVIVTPLDVVKIRLQAQNNPLPKGKCFVYSNGLMDHLCVCEEGGNKLWYKKPGNFQGTLDAFFKIIRNEGIKSLWSGLPPTLVMAVPATVIYFTCYDQLSALLRSKLGENETCIPIVAGIVARFGAVTVISPLELIRTKMQSKKFSYVELHRFVSKKVSEDGWISLWRGWAPTVLRDVPFSAMYWYNYEILKKWLCEKSGLYEPTFMINFTSGALSGSFAAVATLPFDVVKTQKQTQLWTYESHKISMPLHMSTWIIMKNIVAKNGFSGLFSGLIPRLIKIAPACAIMISTYEFGKAFFQKQNVRRQQY

SEQ ID NO: 64322 - protein, 370 aa, Homo sapiens
MGAQPGEPQNTCSRIQTLFRRVKTLLIKAPPPPQPPPPPPSWNPGCTHVYGYAFGHMHDNNLEHLPSQQVLDTGEQLMVPVEVLEVDNKEALWKFLLSGAMAGAVSRTGTAPLDRAKVYMQVYSSKTNFTNLLGGLQSMVQEGGFRSLWRGNGINVLKIAPEYAIKFSVFEQCKNYFCGIQGSPPFQERLLAGSLAVAISQTLINPMEVLKTRLTLRRTGQYKGLLDCARQILQREGTRALYRGYLPNMLGIIPYACTDLAVYEMLQCFWVKSGRDMGDPSGLVSLSSVTLSTTCGQMASYPLTLVRTRMQAQDTVEGSNPTMRGVLQRILAQQGWLGLYRGMTPTLLKVLPAGGISYVVYEAMKKTLGI

SEQ ID NO: 64323 - protein, 242 aa, Homo sapiens
MGAQPGEPQNTCSRIQTLFRRVKTLLIKAPPPPQPPPPPPSWNPGCTHVYGYAFGHMHDNNLEHLPSQQVLDTGEQLMVPVEVLEVDNKEALWKFLLSGAMAGAVSRTGTAPLDRAKVYMQLLGRLRQENRLNLGGGGCSEPRSPDRTPAWATESTPPRRTSPTCWGGYRAWSRRAASAPCGGATASTCSRLLLSMPSSSPYSSSARITSVEYKGPRPSRSVSLLAPWLWPSPRPSSTPWRC

SEQ ID NO: 64324 - protein, 318 aa, Homo sapiens
MGNGVKEGPVRLHEDAEAVLSSSVSSKRDHRQVLSSLLSGALAGALAKTAVAPLDRTKIIFQVSSKRFSAKEAFRVLYYTYLNEGFLSLWRGNSATMVRVVPYAAIQFSAHEEYKRILGSYYGFRGEALPPWPRLFAGALAGTTAASLTYPLDLVRARMAVTPKEMYSNIFHVFIRISREEGLKTLYHGFMPTVLGVIPYAGLSFFTYETLKSLHREYSGRRQPYPFERMIFGACAGLIGQSASYPLDVVRRRMQTAGVTGYPRASIARTLRTIVREEGAVRGLYKGLSMNWVKGPIAVGISFTTFDLMQILLRHLQS

SEQ ID NO: 64325 - protein, 341 aa, Homo sapiens
MATWRRDGRLTGGQRLLCAGLAGTLSLSLTAPLELATVLAQVGVVRGHARGPWATGHRVWRAEGLRALWKGNAVACLRLFPCSAVQLAAYRKFVVLFTDDLGHISQWSSIMAGSLAGMVSTIVTYPTDLIKTRLIMQNILEPSYRGLLHAFSTIYQQEGFLALYRGVSLTVVGALPFSAGSLLVYMNLEKIWNGPRDQFSLPQNFANVCLAAAVTQTLSFPFETVKRKMQAQSPYLPHSGGVDVHFSGAVDCFRQIVKAQGVLGLWNGLTANLLKIVPYFGIMFSTFEFCKRICLYQNGYILSPLSYKLTPGVDQSLQPQELRELKKFFKTRKPKPKKPTL

SEQ ID NO: 64326 - protein, 289 aa, Homo sapiens
MATWRRDGRLTGGQRLLCAGLAGTLSLSLTAPLELAAYRKFVVLFTDDLGHISQWSSIMAGSLAGMVSTIVTYPTDLIKTRLIMQNILEPSYRGLLHAFSTIYQQEGFLALYRGVSLTVVGALPFSAGSLLVYMNLEKIWNGPRDQFSLPQNFANVCLAAAVTQTLSFPFETVKRKMQAQSPYLPHSGGVDVHFSGAVDCFRQIVKAQGVLGLWNGLTANLLKIVPYFGIMFSTFEFCKRICLYQNGYILSPLSYKLTPGVDQSLQPQELRELKKFFKTRKPKPKKPTL

SEQ ID NO: 64327 - protein, 226 aa, Homo sapiens
MATWRRDGRLTGGQRLLCAGLAGTLSLSLTAPLELATVLAQVGVVRGHARGPWATGHRVWRAEGLRALWKGNAVACLRLFPCSAVQLAAYRKFVVLFTDDLGHISQWSSIMAGSLAGMVSTIVTYPTDLIKTRLIMQNILEPSYRGLLHAFSTIYQQEGFLALYRGVSLTVVGSEPLPPTQWRSRCPFLRSSGLLPADSEGPGGPGALEWIDSQFTEDSSIFWNYV

SEQ ID NO: 64328 - protein, 314 aa, Homo sapiens
MEDKRNIQIIEWEHLDKKKFYVFGVAMTMMIRVSVYPFTLIRTRLQVQKGKSLYHGTFDAFIKILRADGITGLYRGFLVNTFTLISGQCYVTTYELTRKFVADYSQSNTVKSLVAGGSASLVAQSITVPIDVVSQHLMMQRKGEKMGRFQVRGNPEGQGVVAFGQTKDIIRQILQADGLRGFYRGYVASLLTYIPNSAVWWPFYHFYAEQLSYLCPKECPHIVFQAVSGPLAAATASILTNPMDVIRTRVQVEGKNSIILTFRQLMAEEGPWGLMKGLSARIISATPSTIVIVVGYESLKKLSLRPELVDSRHW

SEQ ID NO: 64329 - protein, 162 aa, Homo sapiens
MEDKRNIQIIEWEHLDKKKFYVFGVAMTMMIRVSVYPFTLIRTRLQVQKGKSLYHGTFDAFIKILRADGITGLYRGFLVNTFTLISGQCYVTTYELTRKFVADYSQSNTVKSLMAEEGPWGLMKGLSARIISATPSTIVIVVGYESLKKLSLRPELVDSRHW

SEQ ID NO: 64330 - protein, 291 aa, Homo sapiens
MEDKRNIQIIEWEHLDKKKFYVFGVAMTMMIRVSVYPFTLIRTRLQVQKGKSLYHGTFDAFIKILRADGITGLYRGFLVNTFTLISGQCYVTTYELTRKFVADYSQSNTVKSLVAGGSASLVAQSITVRGNPEGQGVVAFGQTKDIIRQILQADGLRGFYRGYVASLLTYIPNSAVWWPFYHFYAEQLSYLCPKECPHIVFQAVSGPLAAATASILTNPMDVIRTRVQVEGKNSIILTFRQLMAEEGPWGLMKGLSARIISATPSTIVIVVGYESLKKLSLRPELVDSRHW

SEQ ID NO: 64331 - protein, 246 aa, Homo sapiens
MVKIYRHESLLGFFKGMSFPIASIAVVNSVLFGVYSNTLLVLTATSHQERRAQPPSYMHIFLAGCTGGFLQAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDMIKSRMQMDGLRRRVYQGMLDCMVSSIRQEGLGVFFRGVTINSARAFPVNAVTFLSYEYLLRWWG

SEQ ID NO: 64332 - protein, 264 aa, Homo sapiens
MPVEEFVAGWISGALGLVLGHPFDTVKLLGFFKGMSFPIASIAVVNSVLFGVYSNTLLVLTATSHQERRAQPPSYMHIFLAGCTGGFLQAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDMIKSRMQMDGLRRRVYQGMLDCMVSSIRQEGLGVFFRGVTINSARAFPVNAVTFLSYEYLLRWWG

SEQ ID NO: 64333 - protein, 184 aa, Homo sapiens
MVKIYRHESAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDMIKSRMQMDGLRRRVYQGMLDCMVSSIRQEGLGVFFRGVTINSARAFPVNAVTFLSYEYLLRWWG

SEQ ID NO: 64334 - protein, 288 aa, Homo sapiens
MPVEEFVAGWISGALGLVLGHPFDTVKVRLQTQTTYRGIVDCMVKIYRHESLLGFFKGMSFPIASIAVVNSVLFGVYSNTLLVLTATSHQERRAQPPSYMHIFLAGCTGGFLQAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDMIKSRMQMDGLRRRVYQGMLDCMVSSIRQEGLGVFFRGVTINSARAFPVNAVTFLSYEYLLRWWG

SEQ ID NO: 64335 - protein, 246 aa, Homo sapiens; identical to SEQ ID NO: 64331

SEQ ID NO: 64336 - protein, 288 aa, Homo sapiens; identical to SEQ ID NO: 64334

SEQ ID NO: 64337 - protein, 118 aa, Homo sapiens
MPVEEFVAGWISGALGLVLGHPFDTVKVRLQTQTTYRGIVDCMVKIYRHESLLGFFKGMSFPIASIAVVNSVLFGVYSNTLLVLTATSHQERRAQPPSYMHIFLAGCTGGFLQAYCLA

SEQ ID NO: 64338 - protein, 418 aa, Homo sapiens
MHPRRPDGFDGLGYRGGARDEQGFGGAFPARSFSTGSDLGHWVTTPPDIPGSRNLHWGEKSPPYGVPTTSTPYEGPTEEPFSSGGGGSVQGQSSEQLNRFAGFGIGLASLFTENVLAHPCIVLRRQCQVNYHAQHYHLTPFTVINIMYSFNKTQGPRALWKGMGSTFIVQGVTLGAEGIISEFTPLPREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 64339 - protein, 337 aa, Homo sapiens
MHPRRPDGFDGLGYRGGARDEQGFGGAFPARSFSTGSDLGHWVTTPPDIPGSRNLHWGEKSPPYGVPTTSTPYEGPTEEPFSSGGGGSVQGQSSEQLNRFAGFGIGLASLFTENVLAHPCIVLRRQCQVNYHAQHYHLTPFTVINIMYSFNKTQGPRALWKGMGSTFIVQGVTLGAEGIISEFTPLPREVLHKWSPKQIGEHLLLKSLTYVVAMPFYSASLIETVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 64340 - protein, 272 aa, Homo sapiens
MYSFNKTQGPRALWKGMGSTFIVQGVTLGAEGIISEFTPLPREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 64341 - protein, 205 aa, Homo sapiens
MPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 64342 - protein, 327 aa, Homo sapiens
MKTEQLNRFAGFGIGLASLFTENVLAHPCIVLRRQCQVNYHAQHYHLTPFTVINIMYSFNKTQGPRALWKGMGSTFIVQGVTLGAEGIISEFTPLPREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 64343 - protein, 256 aa, Homo sapiens
MGSTFIVQGVTLGAEGIISEFTPLPREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 64344 - protein, 272 aa, Homo sapiens; identical to SEQ ID NO: 64340

SEQ ID NO: 64345 - protein, 739 aa, Homo sapiens
MSSESKEQHNVSPRDSAEGNDSYPSGIHLELQRESSTDFKQFETNDQCRPYHRILIERQEKSDTNFKEFVIKKLQKNCQCSPAKAKNMILGFLPVLQWLPKYDLKKNILGDVMSGLIVGILLVPQSIAYSLLAGQEPVYGLYTSFFASIIYFLLGTSRHISVGIFGVLCLMIGETVDRELQKAGYDNAHSAPSLGMVSNGSTLLNHTSDRICDKSCYAIMVGSTVTFIAGVYQVAMGFFQVGFVSVYLSDALLSGFVTGASFTILTSQAKYLLGLNLPRTNGVGSLITTWIHVFRNIHKTNLCDLITSLLCLLVLLPTKELNEHFKSKLKAPIPIELVVVVAATLASHFGKLHENYNSSIAGHIPTGFMPPKVPEWNLIPSVAVDAIAISIIGFAITVSLSEMFAKKHGYTVKANQEMYAIGFCNIIPSFFHCFTTSAALAKTLVKESTGCHTQLSGVVTALVLLLVLLVIAPLFYSLQKSVLGVITIVNLRGALRKFRDLPKMWSISRMDTVIWFVTMLSSALLSTEIGLLVGVCFSIFCVILRTQKPKSSLLGLVEESEVFESVSAYKNLQIKPGIKIFRFVAPLYYINKECFKSALYKQTVNPILIKVAWKKAAKRKIKEKVVTLGGIQDEMSVQLSHDPLELHTIVIDCSAIQFLDTAGIHTLKEVRRDYEAIGIQVLLAQCNPTVRDSLTNGEYCKKEEENLLFYSVYEAMAFAEVSKNQKGVCVPNGLSLSSD

SEQ ID NO: 64346 - protein, 23 aa, Homo sapiens
MSSESKEQHNVSPRDSAEGNDSY

SEQ ID NO: 64347 - protein, 764 aa, Homo sapiens
MIEPFGNQYIVARPVYSTNAFEENHKKTGRHHKTFLDHLKVCCSCSPQKAKRIVLSLFPIASWLPAYRLKEWLLSDIVSGISTGIVAVLQGLAFALLVDIPPVYGLYASFFPAIIYLFFGTSRHISVGPFPILSMMVGLAVSGAVSKAVPDRNATTLGLPNNSNNSSLLDDERVRVAAAASVTVLSGIIQLAFGILRIGFVVIYLSESLISGFTTAAAVHVLVSQLKFIFQLTVPSHTDPVSIFKVLYSVFSQIEKTNIADLVTALIVLLVVSIVKEINQRFKDKLPVPIPIEFIMTVIAAGVSYGCDFKNRFKVAVVGDMNPGFQPPITPDVETFQNTVGDCFGIAMVAFAVAFSVASVYSLKYDYPLDGNQELIALGLGNIVCGVFRGFAGSTALSRSAVQESTGGKTQIAGLIGAIIVLIVVLAIGFLLAPLQKSVLAALALGNLKGMLMQFAEIGRLWRKDKYDCLIWIMTFIFTIVLGLGLGLAASVAFQLLTIVFRTQFPKCSTLANIGRTNIYKNKKDYYDMYEPEGVKIFRCPSPIYFANIGFFRRKLIDAVGFSPLRILRKRNKALRKIRKLQKQGLLQVTPKGFICTVDTIKDSDEELDNNQIEVLDQPINTTDLPFHIDWNDDLPLNIEVPKISLHSLILDFSAVSFLDVSSVRGLKSILQEFIRIKVDVYIVGTDDDFIEKLNRYEFFDGEVKSSIFFLTIHDAVLHILMKKDYSTSKFNPSQEKDGKIDFTINTNGGLRNRVYEVPVETKF

SEQ ID NO: 64348 - protein, 651 aa, Homo sapiens
MLLRKIIKRQEDIIRHFWIISKCVVASWLPAYRLKEWLLSDIVSGISTGIVAVLQGLAFALLVDIPPVYGLYASFFPAIIYLFFGTSRHISVGPFPILSMMVGLAVSGAVSKAVPDRNATTLGLPNNSNNSSLLDDERVRVAAAASVTVLSGIIQLAFGILRIGFVVIYLSESLISGFTTAAAVHVLVSQLKFIFQLTVPSHTDPVSIFKVLYSVFSQIEKTNIADLVTALIVLLVVSIVKEINQRFKDKLPVPIPIEFIMTVIAAGVSYGCDFKNRFKVAVVGDMNPGFQPPITPDVETFQNTVGDCFGIAMVAFAVAFSVASVYSLKYDYPLDGNQELIALGLGNIVCGVFRGFAGSTALSRSAVQESTGGKTQIAGLIGAIIVLIVVLAIGFLLAPLQKSVLAALALGNLKGMLMQFAEIGRLWRKDKYDCLIWIMTFIFTIVLGLGLGLAASVAFQLLTIVFRTQFPKCSTLANIGRTNIYKNKKDYYDMYEPEGVKIFRCPSPIYFANIGFFRRKLIDAVGFSPLRILRKRNKALRKIRKLQKQGLLQVTPILQEFIRIKVDVYIVGTDDDFIEKLNRYEFFDGEVKSSIFFLTIHDAVLHILMKKDYSTSKFNPSQEKDGKIDFTINTNGGLRNRVYEVPVETKF

SEQ ID NO: 64349 - protein, 120 aa, Homo sapiens
MIEPFGNQYIVARPVYSTNAFEENHKKTGRHHKTFLDHLKVCCSCSPQKAKRIVLSLFPIASWLPAYRLKEWLLSDIVSGISTGIVAVLQGLAFALLVDIPPVYGLYASFFPAIIYLFFG

SEQ ID NO: 64350 - protein, 780 aa, Homo sapiens
MAAPGGRSEPPQLPEYSCSYMVSRPVYSELAFQQQHERRLQERKTLRESLAKCCSCSRKRAFGVLKTLVPILEWLPKYRVKEWLLSDVISGVSTGLVATLQGMAYALLAAVPVGYGLYSAFFPILTYFIFGTSRHISVGPFPVVSLMVGSVVLSMAPDEHFLVSSSNGTVLNTTMIDTAARDTARVLIASALTLLVGIIQLIFGGLQIGFIVRYLADPLVGGFTTAAAFQVLVSQLKIVLNVSTKNYNGVLSIIYTLVEIFQNIGDTNLADFTAGLLTIVVCMAVKELNDRFRHKIPVPIPIEVIVTIIATAISYGANLEKNYNAGIVKSIPRGFLPPELPPVSLFSEMLAASFSIAVVAYAIAVSVGKVYATKYDYTIDGNQEFIAFGISNIFSGFFSCFVATTALSRTAVQESTGGKTQVAGIISAAIVMIAILALGKLLEPLQKSVLAAVVIANLKGMFMQLCDIPRLWRQNKIDAVIWVFTCIVSIILGLDLGLLAGLIFGLLTVVLRVQFPSWNGLGSIPSTDIYKSTKNYKNIEEPQGVKILRFSSPIFYGNVDGFKKCIKSTVGFDAIRVYNKRLKALRKIQKLIKSGQLRATKNGIISDAVSTNNAFEPDEDIEDLEELDIPTKEIEIQVDWNSELPVKVNVPKVPIHSLVLDCGAISFLDVVGVRSLRVIVKEFQRIDVNVYFASLQDYVIEKLEQCGFFDDNIRKDTFFLTVHDAILYLQNQVKSQEGQGSILETITLIQDCKDTLELIETELTEEELDVQDEAMRTLAS

SEQ ID NO: 64351 - protein, 131 aa, Homo sapiens
MAAPGGRSEPPQLPEYSCSYMVSRPVYSELAFQQQHERRLQERKTLRESLAKCCSCSRKRAFGVLKTLVPILEWLPKYRVKEWLLSDVISGVSTGLVATLQGMAYALLAAVPVGYGLYSAFFPILTYFIFG

SEQ ID NO: 64352 - protein, 341 aa, Homo sapiens [sequence omitted]

SEQ ID NO: 64353 - protein, 349 aa, Homo sapiens
MIAILALGKLLEPLQKSVLAAVVIANLKGMFMQLCDIPRLWRQNKIDAVIWVFTCIVSIILGLDLGLLAGLIFGLLTVVLRVQFPSWNGLGSIPSTDIYKSTKNYKNIEEPQGVKILRFSSPIFYGNVDGFKKCIKSTVGFDAIRVYNKRLKALRKIQKLIKSGQLRATKNGIISDAVSTNNAFEPDEDIEDLEELDIPTKEIEIQVDWNSELPVKVNVPKVPIHSLVLDCGAISFLDVVGVRSLRVIVKEFQRIDVNVYFASLQDYVIEKLEQCGFFDDNIRKDTFFLTVHDAILYLQNQVKSQEGQGSILETITLIQDCKDTLELIETELTEEELDVQDEAMRTLAS

SEQ ID NO: 64354 - protein, 367 aa, Homo sapiens [sequence omitted]

SEQ ID NO: 64355 - protein, 744 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 64356 - protein, 685 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAFIQR

SEQ ID NO: 64357 - protein, 177 aa, Homo sapiens
MGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 64358 - protein, 335 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGFHTEMTRRWRP

SEQ ID NO: 64359 - protein, 714 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKATQDAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 64360 - protein, 746 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKATQDAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 64361 - protein, 707 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 64362 - protein, 712 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 64363 - protein, 516 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSFHTEMTRRWRP

SEQ ID NO: 64364 - protein, 473 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQTIWLTTFVSSLFLGLDYGLITAVIIALLTVIYRTQR

SEQ ID NO: 64365 - protein, 712 aa, Homo sapiens; identical to SEQ ID NO: 64362

SEQ ID NO: 64366 - protein, 447 aa, Homo sapiens
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQTIWLTTFVSSLFLGLDYGLITAVIIALLTVIYRTQR

SEQ ID NO: 64367 - protein, 651 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 64368 - protein, 738 aa, Homo sapiens
MDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 64369 - protein, 740 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAGPLLSACLAPQQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 64370 - protein, 759 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 64371 - protein, 758 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 64372 - protein, 753 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQDLLSRLHCYHSTLGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAGPLLSACLAPQQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 64373 - protein, 723 aa, Homo sapiens
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVATPGPLPLLTAPGRPTGGAGPDPLRLRGHLPVRTSCPRLYHSCSCAGLRLTAQVCVWPPSEQPLWATVPHLLLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 64374 - protein, 646 aa, Homo sapiens
MRAPGAGAASVVSLALLWLLGLPWTWSAAAALGVYVGSGGWRFLRIVCKTARRDLFGLSVLIRVRLELRRHQRAGHTIPRIFQAVVQRQPERLALVDAGTGECWTFAQLDAYSNAVANLFRQLGFAPGDVVAIFLEGRPEFVGLWLGLAKAGMEAALLNVNLRREPLAFCLGTSGAKALIFGGEMVAAVAEVSGHLGKSLIKFCSGDLGPEGILPDTHLLDPLLKEASTAPLAQIPSKGMDDRLFYIYTSGTTGLPKAAIVVHSRYYRMAAFGHHAYRMQAADVLYDCLPLYHSAGNIIGVGQCLIYGLTVVLRKKFSASRFWDDCIKYNCTVVQYIGEICRYLLKQPVREAERRHRVRLAVGNGLRPAIWEEFTERFGVRQIGEFYGATECNCSIANMDGKVGSCGFNSRILPHVYPIRLVKVNEDTMELLRDAQGLCIPCQAGEPGLLVGQINQQDPLRRFDGYVSESATSKKIAHSVFSKGDSAYLSGDVLVMDELGYMYFRDRSGDTFRWRGENVSTTEVEGVLSRLLGQTDVAVYGVAVPGVEGKAGMAAVADPHSLLDPNAIYQELQKVLAPYARPIFLRLLPQVDTTGTFKIQKTRLQREGFDPRQTSDRLFFLDLKQGHYLPLNEAVYTRICSGAFAL

SEQ ID NO: 64375 - protein, 240 aa, Homo sapiens
PEFVGLWLGLAKAGMEAALLNVNLRREPLAFCLGTSGAKALIFGGEMVAAVAEVSGHLGKSLIKFCSGDLGPEGILPDTHLLDPLLKEASTAPLAQIPSKGMDDRLFYIYTSGTTGLPKAAIVVHSRYYRMAAFGHHAYRMQAADVLYDCLPLYHSAGNIIGVGQCLIYGLTVVLRKKFSASRFWDDCIKYNCTWHGPSWTEKLEPQRNPCLSAALVPLCLPPLPAFQPLSPSIPVPVWP

SEQ ID NO: 64376 - protein, 646 aa, Homo sapiens; identical to SEQ ID NO: 64374

SEQ ID NO: 64377 - protein, 620 aa, Homo sapiens
MLSAIYTVLAGLLFLPLLVNLCCPYFFQDIGYFLKVAAVGRRVRSYGKRRPARTILRAFLEKARQTPHKPFLLFRDETLTYAQVDRRSNQVARALHDHLGLRQGDCVALLMGNEPAYVWLWLGLVKLGCAMACLNYNIRAKSLLHCFQCCGAKVLLVSPELQAAVEEILPSLKKDDVSIYYVSRTSNTDGIDSFLDKVDEVSTEPIPESWRSEVTFSTPALYIYTSGTTGLPKAAMITHQRIWYGTGLTFVSGLKADDVIYITLPFYHSAALLIGIHGCIVAGATLALRTKFSASQFWDDCRKYNVTVIQYIGELLRYLCNSPQKPNDRDHKVRLALGNGLRGDVWRQFVKRFGDICIYEFYAATEGNIGFMNYARKVGAVGRVNYLQKKIITYDLIKYDVEKDEPVRDENGYCVRVPKGEVGLLVCKITQLTPFNGYAGAKAQTEKKKLRDVFKKGDLYFNSGDLLMVDHENFIYFHDRVGDTFRWKGENVATTEVADTVGLVDFVQEVNVYGVHVPDHEGRIGMASIKMKENHEFDGKKLFQHIADYLPSYARPRFLRIQDTIEITGTFKHRKMTLVEEGFNPAVIKDALYFLDDTAKMYVPMTEDIYNAISAKTLKL

SEQ ID NO: 64378 - protein, 567 aa, Homo sapiens
MLSAIYTVLAGLLFLPLLVNLCCPYFFQDIGYFLKVAAVGRRVRSYGKRRPARTILRAFLEKARQTPHKPFLLFRDETLTYAQVDRRSNQVARALHDHLGLRQGDCVALLMGNEPAYVWLWLGLVKLGCAMACLNYNIRAKSLLHCFQCCGAKVLLVSPELQAAVEEILPSLKKDDVSIYYVSRTSNTDGIDSFLDKVDEVSTEPIPESWRSEVTFSTPALYIYTSGTTGATLALRTKFSASQFWDDCRKYNVTVIQYIGELLRYLCNSPQKPNDRDHKVRLALGNGLRGDVWRQFVKRFGDICIYEFYAATEGNIGFMNYARKVGAVGRVNYLQKKIITYDLIKYDVEKDEPVRDENGYCVRVPKGEVGLLVCKITQLTPFNGYAGAKAQTEKKKLRDVFKKGDLYFNSGDLLMVDHENFIYFHDRVGDTFRWKGENVATTEVADTVGLVDFVQEVNVYGVHVPDHEGRIGMASIKMKENHEFDGKKLFQHIADYLPSYARPRFLRIQDTIEITGTFKHRKMTLVEEGFNPAVIKDALYFLDDTAKMYVPMTEDIYNAISAKTLKL

SEQ ID NO: 64379 - protein, 811 aa, Homo sapiens
MPKPPKPRNNLEDRHNPGIQGRREHRPGPGRVRAASSPGGSAPRAERRLWGEGWESGAAPHPHSSRVSALRPCGVVGAWVGMGVCQRTRAPWKEKSQLERAALGFRKGGSGMFASGWNQTVPIEEAGSMAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPGEPGLLVAPVSQQSPFLGYAGGPELAQGKLLKDVFRPGDVFFNTGDLLVCDDQGFLRFHDRTGDTFRWKGENVATTEVAEVFEALDFLQEVNVYGVTVPGHEGRAGMAALVLRPPHALDLMQLYTHVSENLPPYARPRFLRLQESLATTETFKQQKVRMANEGFDPSTLSDPLYVLDQAVGAYLPLTTARYSALLAGNLRI

SEQ ID NO: 64380 - protein, 730 aa, Homo sapiens
MGVCQRTRAPWKEKSQLERAALGFRKGGSGMFASGWNQTVPIEEAGSMAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPGEPGLLVAPVSQQSPFLGYAGGPELAQGKLLKDVFRPGDVFFNTGDLLVCDDQGFLRFHDRTGDTFRWKGENVATTEVAEVFEALDFLQEVNVYGVTVPGHEGRAGMAALVLRPPHALDLMQLYTHVSENLPPYARPRFLRLQESLATTETFKQQKVRMANEGFDPSTLSDPLYVLDQAVGAYLPLTTARYSALLAGNLRI

SEQ ID NO: 64381 - protein, 643 aa, Homo sapiens
MLLGASLVGVLLFSKLVLKLPWTQVGFSLLFLYLGSGGWRFIRVFIKTIRRDIFGGLVLLKVKAKVRQCLQERRTVPILFASTVRRHPDKTALIFEGTDTHWTFRQLDEYSSSVANFLQARGLASGDVAAIFMENRNEFVGLWLGMAKLGVEAALINTNLRRDALLHCLTTSRARALVFGSEMASAICEVHASLDPSLSLFCSGSWEPGAVPPSTEHLDPLLKDAPKHLPSCPDKGFTDKLFYIYTSGTTGLPKAAIVVHSRYYRMAALVYYGFRMRPNDIVYDCLPLYHSAGNIVGIGQCLLHGMTVVIRKKFSASRFWDDCIKYNCTIVQYIGELCRYLLNQPPREAENQHQVRMALGNGLRQSIWTNFSSRFHIPQVAEFYGATECNCSLGNFDSQVGACGFNSRILSFVYPIRLVRVNEDTMELIRGPDGVCIPCQPGEPGQLVGRIIQKDPLRRFDGYLNQGANNKKIAKDVFKKGDQAYLTGDVLVMDELGYLYFRDRTGDTFRWKGENVSTTEVEGTLSRLLDMADVAVYGVEVPGTEGRAGMAAVASPTGNCDLERFAQVLEKELPLYARPIFLRLLPELHKTGTYKFQKTELRKEGFDPAIVKDPLFYLDAQKGRYVPLDQEAYSRIQAGEEKL

SEQ ID NO: 64382 - protein, 237 aa, Homo sapiens
MPLTLSTLLQPGRIWTGRRAAEPTPGHNAAWSLSGGGAAVLQAGAETALDPGGILPVVPLLGIWRLALHPGLHQDHQAYLTGDVLVMDELGYLYFRDRTGDTFRWKGENVSTTEVEGTLSRLLDMADVAVYGVEVPGTEGRAGMAAVASPTGNCDLERFAQVLEKELPLYARPIFLRLLPELHKTGTYKFQKTELRKEGFDPAIVKDPLFYLDAQKGRYVPLDQEAYSRIQAGEEKL

SEQ ID NO: 64383 - protein, 690 aa, Homo sapiens
MGVRQQLALLLLLLLLLWGLGQPVWPVAVALTLRWLLGDPTCCVLLGLAMLARPWLGPWVPHGLSLAAAALALTLLPARLPPGLRWLPADVIFLAKILHLGLKIRGCLSRQPPDTFVDAFERRARAQPGRALLVWTGPGAGSVTFGELDARACQAAWALKAELGDPASLCAGEPTALLVLASQAVPALCMWLGLAKLGCPTAWINPHGRGMPLAHSVLSSGARVLVVDPDLRESLEEILPKLQAENIRCFYLSHTSPTPGVGALGAALDAAPSHPVPADLRAGITWRSPALFIYTSGTTGLPKPAILTHERVLQMSKMLSLSGATADDVVYTVLPLYHVMGLVVGILGCLDLGATCVLAPKFSTSCFWDDCRQHGVTVILYVGELLRYLCNIPQQPEDRTHTVRLAMGNGLRADVWETFQQRFGPIRIWEVYGSTEGNMGLVNYVGRCGALGKMSCLLRMLSPFELVQFDMEAAEPVRDNQGFCIPVGLGEPGLLLTKVVSQQPFVGYRGPRELSERKLVRNVRQSGDVYYNTGDVLAMDREGFLYFRDRLGDTFRWKGENVSTHEVEGVLSQVDFLQQVNVYGVCVPGCEGKVGMAAVQLAPGQTFDGEKLYQHVRAWLPAYATPHFIRIQDAMEVTSTFKLMKTRLVREGFNVGIVVDPLFVLDNRAQSFRPLTAEMYQAVCEGTWRL

SEQ ID NO: 64384 - protein, 649 aa, Homo sapiens
MENDPSRRRESISLTPVAKGLENMGADFLESLEEGQLPRSDLSPAEIRSSWSEAAPKPFSRWRNLQPALRARSFCREHMQLFRWIGTGLLCTGLSAFLLVACLLDFQRALALFVLTCVVLTFLGHRLLKRLLGPKLRRFLKPQGHPRLLLWFKRGLALAAFLGLVLWLSLDTSQRPEQLVSFAGICVFVALLFACSKHHCAVSWRAVSWGLGLQFVLGLLVIRTEPGFIAFEWLGEQIRIFLSYTKAGSSFVFGEALVKDVFAFQVLPIIVFFSCVISVLYHVGLMQWVILKIAWLMQVTMGTTATETLSVAGNIFVSQTEAPLLIRPYLADMTLSEVHVVMTGGYATIAGSLLGAYISFGIDATSLIAASVMAAPCALALSKLVYPEVEESKFRREEGVKLTYGDAQNLIEAASTGAAISVKVVANIAANLIAFLAVLDFINAALSWLGDMVDIQGLSFQLICSYILRPVAFLMGVAWEDCPVVAELLGIKLFLNEFVAYQDLSKYKQRRLAGAEEWVGDRKQWISVRAEVLTTFALCGFANFSSIGIMLGGLTSMVPQRKSDFSQIVLRALFTGACVSLVNACMAGILYMPRGAEVDCMSLLNTTLSSSSFEIYQCCREAFQSVNPEFSPEALDNCCRFYNHTICAQ

SEQ ID NO: 64385 - protein, 175 aa, Homo sapiens
MENDPSRRRESISLTPVAKGLENMGADFLESLEEGQLPRSDLSPAEIRSSWSEAAPKPFSRWRNLQPALRARSFCREHMQLFRWIGTGLLCTGLSAFLLVACLLDFQRALALFVLTCVVLTFLGHRLLKRLLGPKLRRFLKPQGHPRLLLWFKRDPRPWSKEGPNQYLPQITWTV

SEQ ID NO: 64386 - protein, 649 aa, Homo sapiens; identical to SEQ ID NO: 64384

SEQ ID NO: 64387 - protein, 543 aa, Homo sapiens
MENDPSRRRESISLTPVAKGLENMGADFLESLEEGQLPRSDLSPAEIRSSWSEAAPKPFSRWRNLQPALRARSFCREHMQLFRWIGTGLLCTGLSAFLLVACLLDFQRALALFVLTCVVLTFLGHRLLKRLLGPKLRRFLKPQGHPRLLLWFKRGLALAAFLGLVLWLSLDTSQRPEQLVSFAGICVFVALLFACSKHHCAVSWRAVSWGLGLQFVLGLLVIRTEPGFIAFEWLGEQIRIFLSYTKAGSSFVFGEALVKDVFAFQVLPIIVFFSCVISVLYHVGLMQWVILKIAWLMQVTMGTTATETLSVAGNIFVSQTEAPLLIRPYLADMTLSEVHVVMTGGYATIAGSLLGAYISFGIDATSLIAASVMAAPCALALSKLVYPEVEESKFRREEGVKLTYGDAQNLIEAASTGAAISVKVVANIAANLIAFLAVLDFINAALSWLGDMVDIQGLSFQLICSYILRPVAFLMGVAWEDCPVVAELLGIKLFLNEFVAYQDLSKYKQRRLAGAEEWVGDRKQWISRRGLAMLTRLVLNSWP

SEQ ID NO: 64388 - protein, 636 aa, Homo sapiens
MENDPSRRRESISLTPVAKGLENMGADFLESLEEGQLPRSDLSPAEIRSSWSEAAPKPFSRWRNLQPALRARSFCREHMQLFRWIGTGLLCTGLSAFLLVACLLDFQRALALFVLTCVVLTFLGHRLLKRLLGPKLRRFLKPQGHPRLLLWFKRGLALAAFLGLVLWLSLDTSQRPEQLVSFAGICVFVALLFACSKHHCAVSWRAVSWGLGLQFVLGLLVIRTEPGFIAFEWLGEQIRIFLSYTKAGSSFVFGEALVKDVFAFQVLPIIVFFSCVISVLYHVGLMQWVILKIAWLMQVTMGTTATETLSVAGNIFVSQTEAPLLIRPYLADMTLSEVHVVMTGGYATIAGSLLGAYISFGIDATSLIAASVMAAPCALALSKLVYPEVEESKFRREEGVKLTYGDAQNLIEAASTGAAISVKVVANIAANLIAFLAVLDFINAALSWLGDMVDIQGLSFQLICSYILRPVAFLMGVAWEDCPVVAELLGIKLFLNEFVAYQDLSKYKQRRLAGAEEWVGDRKQWISVRAEVLTTFALCGFANFSSIGIMLGGLTSMVPQRKSDFSQIVLRALFTGACVSLVNACMAGILYMPRGAEVDCMSLLNTTLSSSSFEIYQCCREAFQRIFKSTPAESQP

SEQ ID NO: 64389 - protein, 287 aa, Homo sapiens
MQLFRWIGTGLLCTGLSAFLLVACLLDFQRALALFVLTCVVLTFLGHRLLKRLLGPKLRRFLKPQGHPRLLLWFKRGLALAAFLGLVLWLSLDTSQRPEQLVSFAGICVFVALLFACSKHHCAVSWRAVSWGLGLQFVLGLLVIRTEPGFIAFEWLGEQIRIFLSYTKAGSSFVFGEALVKDVFAFQVLPIIVFFSCVISVLYHVGLMQWVILKIAWLMQVTMGTTATETLSVAGNIFVSQTEAPLLIRPYLADMTLSEVHVVMTGGYATIAGSLLGAYISFGLEKL

SEQ ID NO: 64390 - protein, 483 aa, Homo sapiens
MENDPSRRRESISLTPVAKGLENMGADFLESLEEGQLPRSDLSPAEIRSSWSEAAPKPFSRWRNLQPALRARSFCREHMQLFRWIGTGLLCTGLSAFLLVACLLDFQRALALFVLTCVVLTFLGHRLLKRLLGPKLRRFLKPQGHPRLLLWFKRGLALAAFLGLVLWLSLDTSQRPEQLVSFAGICVFVALLFACSKHHCAVSWRAVSWGLGLQFVLGLLVIRTEPGFIAFEWLGEQIRIFLSYTKAGSSFVFGEALVKDVFAFQVLPIIVFFSCVISVLYHVGLMQWVILKIAWLMQVTMGTTATETLSVAGNIFVSQTEAPLLIRPYLADMTLSEVHVVMTGGYATIAGSLLGAYISFGVRAEVLTTFALCGFANFSSIGIMLGGLTSMVPQRKSDFSQIVLRALFTGACVSLVNACMAGILYMPRGAEVDCMSLLNTTLSSSSFEIYQCCREAFQSVNPEFSPEALDNCCRFYNHTICAQ

SEQ ID NO: 64391 - protein, 658 aa, Homo sapiens
MEKASGRQSIALSTVETGTVNPGLELMEKEVEPEGSKRTDAQGHSLGDGLGPSTYQRRSRWPFSKARSFCKTHASLFKKILLGLLCLAYAAYLLAACILNFQRALALFVITCLVIFVLVHSFLKKLLGKKLTRCLKPFENSRLRLWTKWVFAGVSLVGLILWLALDTAQRPEQLIPFAGICMFILILFACSKHHSAVSWRTVFSGLGLQFVFGILVIRTDLGYTVFQWLGEQVQIFLNYTVAGSSFVFGDTLVKDVFAFQALPIIIFFGCVVSILYYLGLVQWVVQKVAWFLQITMGTTATETLAVAGNIFVGMTEAPLLIRPYLGDMTLSEIHAVMTGGFATISGTVLGAFIAFGVDASSLISASVMAAPCALASSKLAYPEVEESKFKSEEGVKLPRGKERNVLEAASNGAVDAIGLATNVAANLIAFLAVLAFINAALSWLGELVDIQGLTFQVICSYLLRPMVFMMGVEWTDCPMVAEMVGIKFFINEFVAYQQLSQYKNKRLSGMEEWIEGEKQWISVRAEIITTFSLCGFANLSSIGITLGGLTSIVPHRKSDLSKVVVRALFTGACVSLISACMAGILYVPRGAEADCVSFPNTSFTNRTYETYMCCRGLFQSTSLNGTNPPSFSGPWEDKEFSAMALTNCCGFYNNTVCA

SEQ ID NO: 64392 - protein, 691 aa, Homo sapiens
MELRSTAAPRAEGYSNVGFQNEENFLENENTSGNNSIRSRAVQSREHTNTKQDEEQVTVEQDSPRNREHMEDDDEEMQQKGCLERRYDTVCGFCRKHKTTLRHIIWGILLAGYLVMVISACVLNFHRALPLFVITVAAIFFVVWDHLMAKYEHRIDEMLSPGRRLLNSHWFWLKWVIWSSLVLAVIFWLAFDTAKLGQQQLVSFGGLIMYIVLLFLFSKYPTRVYWRPVLWGIGLQFLLGLLILRTDPGFIAFDWLGRQVQTFLEYTDAGASFVFGEKYKDHFFAFKVLPIVVFFSTVMSMLYYLGLMQWIIRKVGWIMLVTTGSSPIESVVASGNIFVGQTESPLLVRPYLPYITKSELHAIMTAGFSTIAGSVLGAYISFGVPSSHLLTASVMSAPASLAAAKLFWPETEKPKITLKNAMKMESGDSGNLLEAATQGASSSISLVANIAVNLIAFLALLSFMNSALSWFGNMFDYPQLSFELICSYIFMPFSFMMGVEWQDSFMVARLIGYKTFFNEFVAYEHLSKWIHLRKEGGPKFVNGVQQYISIRSEIIATYALCGFANIGSLGIVIGGLTSMAPSRKRDIASGAVRALIAGTVACFMTACIAGILSSTPVDINCHHVLENAFNSTFPGNTTKVIACCQSLLSSTVAKGPGEVIPGGNHSLYSLKGCCTLLNPSTFNCNGISNTF

SEQ ID NO: 64393 - protein, 622 aa, Homo sapiens
MEDDDEEMQQKGCLERRYDTVCGFCRKHKTTLRHIIWGILLAGYLVMVISACVLNFHRALPLFVITVAAIFFVVWDHLMAKYEHRIDEMLSPGRRLLNSHWFWLKWVIWSSLVLAVIFWLAFDTAKLGQQQLVSFGGLIMYIVLLFLFSKYPTRVYWRPVLWGIGLQFLLGLLILRTDPGFIAFDWLGRQVQTFLEYTDAGASFVFGEKYKDHFFAFKVLPIVVFFSTVMSMLYYLGLMQWIIRKVGWIMLVTTGSSPIESVVASGNIFVGQTESPLLVRPYLPYITKSELHAIMTAGFSTIAGSVLGAYISFGVPSSHLLTASVMSAPASLAAAKLFWPETEKPKITLKNAMKMESGDSGNLLEAATQGASSSISLVANIAVNLIAFLALLSFMNSALSWFGNMFDYPQLSFELICSYIFMPFSFMMGVEWQDSFMVARLIGYKTFFNEFVAYEHLSKWIHLRKEGGPKFVNGVQQYISIRSEIIATYALCGFANIGSLGIVIGGLTSMAPSRKRDIASGAVRALIAGTVACFMTACIAGILSSTPVDINCHHVLENAFNSTFPGNTTKVIACCQSLLSSTVAKGPGEVIPGGNHSLYSLKGCCTLLNPSTFNCNGISNTF

SEQ ID NO: 64394 - protein, 535 aa, Homo sapiens
MRRERTRGPQAWEFPSPTKSGCSLQSLSRDLRELREGEKPEDQAETEESWQGLARKTPGKACAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINSFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSLVLARLVFVPLLLLCNIKPRRYLTVVFEHDAWFIFFMAAFAFSNGYLASLCMCFGPKKVKPAEAETAGAIMAFFLCLGLALGAVFSFLFRAIV

SEQ ID NO: 64395 - protein, 456 aa, Homo sapiens [sequence omitted]

SEQ ID NO: 64396 - protein, 456 aa, Homo sapiens [sequence omitted]

SEQ ID NO: 64397 - protein, 456 aa, Homo sapiens [sequence omitted]

SEQ ID NO: 64398 - protein, 456 aa, Homo sapiens [sequence omitted]

SEQ ID NO: 64399 - protein, 456 aa, Homo sapiens [sequence omitted]

SEQ ID NO: 64400 - protein, 456 aa, Homo sapiens [sequence omitted]

SEQ ID NO: 64401 - protein, 456 aa, Homo sapiens [sequence omitted]

SEQ ID NO: 64402 - protein, 456 aa, Homo sapiens [sequence omitted]

SEQ ID NO: 64403 - protein, 456 aa, Homo sapiens [sequence omitted]

SEQ ID NO: 64404 - protein, 169 aa, Homo sapiens
MRRERTRGPQAWEFPSPTKSGCSLQSLSRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLI

SEQ ID NO: 64405 - protein, 456 aa, Homo sapiens
MARGDAPRDSYHLVGISFFILGLGTLLPWNFFITAIPYFQARLAGAGNSTARILSTNHTGPEDAFNFNNWVTLLSQLPLLLFTLLNSFLYQCVPETVRILGSLLAILLLFALTAALVKVDMSPGPFFSITMASVCFINSFSAVLQGSLFGQLGTMPSTYSTLFLSGQGLAGIFAALAMLLSMASGVDAETSALGYFITPCVGILMSIVCYLSLPHLKFARYYLANKSSQAQAQELETKAELLQSDENGIPSSPQKVALTLDLDLEKEPESEPDEPQKPGKPSVFTVFQKIWLTALCLVLVFTVTLSVFPAITAMVTSSTSPGKWSQFFNPICCFLLFNIMDWLGRSLTSYFLWPDEDSRLLPLLVCLRFLFVPLFMLCHVPQRSRLPILFPQDAYFITFMLLFAVSNGYLVSLTMCLAPRQVLPHEREVAGALMTFFLALGLSCGASLSFLFKALL

SEQ ID NO: 64406 - protein, 456 aa, Homo sapiens; identical to SEQ ID NO: 64405

SEQ ID NO: 64407 - protein, 456 aa, Homo sapiens; identical to SEQ ID NO: 64405

SEQ ID NO: 64408 - protein, 475 aa, Homo sapiens
MAVVSEDDFQHSSNSTYRTTSSSLRADQEALLEKLLDRPPPGLQRPEDRFCGTYIIFFSLGIGSLLPWNFFITAKEYWMFKLRNSSSPATGEDPEGSDILNYFESYLAVASTVPSMLCLVANFLLVNRVAVHIRVLASLTVILAIFMVITALVKVDTSSWTRGFFAVTIVCMVILSGASTVFSSSIYGMTGSFPMRNSQALISGGAMGGTVSAVASLVDLAASSDVRNSALAFFLTATVFLVLCMGLYLLLSRLEYARYYMRPVLAAHVFSGEEELPQDSLSAPSVASRFIDSHTPPLRPILKKTASLGFCVTYVFFITSLIYPAICTNIESLNKGSGSLWTTKFFIPLTTFLLYNFADLCGRQLTAWIQVPGPNSKALPGFVLLRTCLIPLFVLCNYQPRVHLKTVVFQSDVYPALLSSLLGLSNGYLSTLALLYGPKIVPRELAEATGVVMSFYVCLGLTLGSACSTLLVHLI

SEQ ID NO: 64409 - protein, 529 aa, Homo sapiens
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 64410 - protein, 568 aa, Homo sapiens
MELQPPEASIAVVSIPRQLPGSHSEAGVQGLSAGDDSGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 64411 - protein, 630 aa, Homo sapiens
MELQPPEASIAVVSIPRQLPGSHSEAGVQGLSAGDDSELGSHCVAQTGLELLASGDPLPSASQNAEMIETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 64412 - protein, 631 aa, Homo sapiens
MELQPPEASIAVVSIPRQLPGSHSEAGVQGLSAGDDSETGSDCVTQAGLQLLASSDPPALASKNAEVTVETGFHHVSQADIEFLTSIDPTASASGSAGITGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 64413 - protein, 661 aa, Homo sapiens
MELQPPEASIAVVSIPRQLPGSHSEAGVQGLSAGDDSELGSHCVAQTGLELLASGDPLPSASQNAEMIETGSDCVTQAGLQLLASSDPPALASKNAEVTETGFHHVSQADIEFLTSIDPTASASGSAGITGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 64414 - protein, 511 aa, Homo sapiens
MSQDTEVDMKEVELNELEPEKQPMNAASGAAMSLAGAEKNGLVKIKVAEDEAEAAAAAKFTGLSKEELLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 64415 - protein, 135 aa, Homo sapiens
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGH

SEQ ID NO: 64416 - protein, 685 aa, Homo sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKMRIRLSTNSADKGSKVDTSGIFLDKGEGLIFEHNTKNLLHRQTAFRDRCFVSNRACYSSVLNILYTSC

SEQ ID NO: 64417 - protein, 621 aa, Homo sapiens
MKTFWSRPRIQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKMRIRLSTNSADKGSKVDTSGIFLDKGEGLIFEHNTKNLLHRQTAFRDRCFVSNRACYSSVLNILYTSC

SEQ ID NO: 64418 - protein, 551 aa, Homo sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVLLRHPCSSAVA

SEQ ID NO: 64419 - protein, 507 aa, Homo sapiens
MGCWGRNRGRLLCMLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHGHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKAFVEIINSTHASVYEAGPCWVLYLDPTLCVVMVCILLYTTYPLLKESALILLQTVPKQIDIRNLIKELRNVEGVEEVHELHVWQLAGSRIIATAHIKCEDPTSYMEVAKTIKDVFHNHGIHATTIQPEFASVGSKSSVVPCELACRTQCALKQCCGTLPQAPSGKDAEKTPAVSISCLELSNNLEKKPRRTKAENIPAVVIEIKNMPNKQPESSL

SEQ ID NO: 64420 - protein, 372 aa, Homo sapiens
MEAKEKQHLLDARPAIRSYTGSLWQEGAGWIPLPRPGLDLQAIELAAQSNHHCHAQKGPDSHCDPKKGKAQRQLYVASAICLLFMIGEVVGGYLAHSLAVMTDAAHLLTDFASMLISLFSLWMSSRPATKTMNFGWQRAEILGALVSVLSIWVVTGVLVYLAVERLISGDYEIDGGTMLITSGCAVAVNIIMGLTLHQSGHGHSHGTTNQQEENPSVRAAFIHVIGDFMQSMGVLVAAYILYFKPEYKYVDPICTFVFSILVLGTTLTILRDVILVLMEGTPKGVDFTAVRDLLLSVEGVEALHSLHIWALTVAQPVLSVHIAIAQNTDAQAVLKTASSRLQGKFHFHTVTIQIEDYSEDMKDCQACQGPSD

SEQ ID NO: 64421 - protein, 323 aa, Homo sapiens
MEAKEKQHLLDARPAIRSYTGSLWQEGAGWIPLPRPGLDLQAIELAAQSNHHCHAQKGPDSHCDPKKGKAQRQLYVASAICLLFMIGEVVEILGALVSVLSIWVVTGVLVYLAVERLISGDYEIDGGTMLITSGCAVAVNIIMGLTLHQSGHGHSHGTTNQQEENPSVRAAFIHVIGDFMQSMGVLVAAYILYFKPEYKYVDPICTFVFSILVLGTTLTILRDVILVLMEGTPKGVDFTAVRDLLLSVEGVEALHSLHIWALTVAQPVLSVHIAIAQNTDAQAVLKTASSRLQGKFHFHTVTIQIEDYSEDMKDCQACQGPSD

SEQ ID NO: 64422 - protein, 388 aa, Homo sapiens
MEPSPAAGGLETTRLVSPRDRGGAGGSLRLKSLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEEPLPLGNTSVRAAFVHVLGDLLQSFGVLAASILIYFKPQYKAADPISTFLFSICALGSTAPTLRDVLRILMEGTPRNVGFEPVRDTLLSVPGVRATHELHLWALTLTYHVASAHLAIDSTADPEAVLAEASSRLYSRFGFSSCTLQVEQYQPEMAQCLRCQEPPQA

SEQ ID NO: 64423 - protein, 99 aa, Homo sapiens
MPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALA

SEQ ID NO: 64424 - protein, 240 aa, Homo sapiens
MPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEEPLPLGNTSVRAAFVHVLGDLLQSFGVLAASILIYFKPQYKAADPISTFLFSICALGSTAPTLRDVL

SEQ ID NO: 64425 - protein, 383 aa, Homo sapiens
MRVAAGARGENIEHLKLRLEARPPTLLLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEEPLPLGNTSVRAAFVHVLGDLLQSFGVLAASILIYFKPQYKAADPISTFLFSICALGSTAPTLRDVLRILMEGTPRNVGFEPVRDTLLSVPGVRATHELHLWALTLTYHVASAHLAIDSTADPEAVLAEASSRLYSRFGFSSCTLQVEQYQPEMAQCLRCQEPPQA

SEQ ID NO: 64426 - protein, 111 aa, Homo sapiens
MPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGIL

SEQ ID NO: 64427 - protein, 429 aa, Homo sapiens
MAGSGAWKRLKSMLRKDDAPLFLNDTSAFDFSDEAGDEGLSRFNKLRVVVADDGSEAPERPVNGAHPTLQADDDSLLDQDLPLTNSQLSLKVDSCDNCSKQREILKQRKVKARLTIAAVLYLLFMIGELVGGYIANSLAIMTDALHMLTDLSAIILTLLALWLSSKSPTKRFTFGFHRLEVLSAMISVLLVYILMGFLLYEAVQRTIHMNYEINGDIMLITAAVGVAVNVIMGFLLNQSGHRHSHSHSLPSNSPTRGSGCERNHGQDSLAVRAAFVHALGDLVQSVGVLIAAYIIRFKPEYKIADPICTYVFSLLVAFTTFRIIWDTVVIILEGVPSHLNVDYIKEALMKIEDVYSVEDLNIWSLTSGKSTAIVHIQLIPGSSSKWEEVQSKANHLLLNTFGMYRCTIQLQSYRQEVDRTCANCQSSSP

SEQ ID NO: 64428 - protein, 118 aa, Homo sapiens
MEEKYGGDVLAGPGGGGGLGPVDVPSARLTKYIVLLCFTKFLKAVGLFESYDLLKAVHIVQFIFILKLGTAFFMVLFQKPFSSGKTITKHQIIGSLKIPGRKEFKDKKLNDPRKLVGN

SEQ ID NO: 64429 - protein, 765 aa, Homo sapiens
MEEKYGGDVLAGPGGGGGLGPVDVPSARLTKYIVLLCFTKFLKAVGLFESYDLLKAVHIVQFIFILKLGTAFFMVLFQKPFSSGKTITKHQWIKIFKHAVAGCIISLLWFFGLTLCGPLRTLLLFEHSDIVVISLLSVLFTSSGGGPAKTRGAAFFIIAVICLLLFDNDDLMAKMAEHPEGHHDSALTHMLYTAIAFLGVADHKGGVLLLVLALCCKVGFHTASRKLSVDVGGAKRLQALSHLVSVLLLCPWVIVLSVTTESKVESWFSLIMPFATVIFFVMILDFYVDSICSVKMEVSKCARYGSFPIFISALLFGNFWTHPITDQLRAMNKAAHQESTEHVLSGGVVVSAIFFILSANILSSPSKRGQKGTLIGYSPEGTPLYNFMGDAFQHSSQSIPRFIKESLKQILEESDSRQIFYFLCLNLLFTFVELFYGVLTNSLGLISDGFHMLFDCSALVMGLFAALMSRWKATRIFSYGYGRIEILSGFINGLFLIVIAFFVFMESVARLIDPPELDTHMLTPVSVGGLIVNLIGICAFSHAHSHAHGASQGSCHSSDHSHSHHMHGHSDHGHGHSHGSAGGGMNANMRGVFLHVLADTLGSIGVIVSTVLIEQFGWFIADPLCSLFIAILIFLSVVPLIKDACQVLLLRLPPEYEKELHIALEKIQKIEGLISYRDPHFWRHSASIVAGTIHIQVTSDVLEQRIVQQVTGILKDAGVNNLTIQVEKEAYFQHMSGLSTGFHDVLAMTKQMESMKYCKDGTYIM

SEQ ID NO: 64430 - protein, 360 aa, Homo sapiens [sequence omitted]

SEQ ID NO: 64431 - protein, 461 aa, Homo sapiens
MGTIHLFRKPQRSFFGKLLREFRLVAADRRSWKILLFGVINLICTGFLLMWCSSTNSIALTAYTYLTIFDLFSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 64432 - protein, 264 aa, Homo sapiens
MNPFVLIDLAGAFALCITYMLIEINNYFAVDTASAIAIALMTFGTMYPMSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 64433 - protein, 501 aa, Homo sapiens
MGTIHLFRKPQRSFFGKLLREFRLVAADRRSWKILLFGVINLICTGFLLMWCSSTNSIALTAYTYLTIFDLFRDGVSPFWLGWSQTPDLKWSTHLGLPKCWDNRRELPCLSNSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 64434 - protein, 387 aa, Homo sapiens
MTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 64435 - protein, 438 aa, Homo sapiens
MGTIHLFRKPQRSFFGKLLREFRLVAADRRSWKILLFGVINLICTGFLLMWCSSTNSIALTAYTYLTIFDLFSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 64436 - protein, 432 aa, Homo sapiens
MSWKILLFGVINLICTGFLLMWCSSTNSIALTAYTYLTIFDLFSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 64437 - protein, 376 aa, Homo sapiens
MLPLSIKDDEYKPPKFNLFGKISGWFRSILSDKTSRNLFFFLCLNLSFAFVELLYGIWSNCLGLISDSFHMFFDSTAILAGLAASVISKWRDNDAFSYGYVRAEVLAGFVNGLFLIFTAFFIFSEGVERALAPPDVHHERLLLVSILGFVVNLIGIFVFKHGGHGHSHGSGHGHSHSLFNGALDQAHGHVDHCHSHEVKHGAAHSHDHAHGHGHFHSHDGPSLKETTGPSRQILQGVFLHILADTLGSIGVIASAIMMQNFGLMIADPICSILIAILIVVSVIPLLRESVGILMQRTPPLLENSLPQCYQRVQQLQGVYSLQEQHFWTLCSDVYVGTLKLIVAPDADARWILSQTHNIFTQAGVRQLYVQIDFAAM

SEQ ID NO: 64438 - protein, 90 aa, Homo sapiens
  MOD_RES (1)..(1): Any amino acid
XVIPLLRESVGILMQRTPPLLENSLPQCYQRVQQLQGVYSLQEQHFWTLCSDVYVGTLKLIVAPDADARWILSQTHNIFTQKLEEENENL

SEQ ID NO: 64439 - protein, 376 aa, Homo sapiens; identical to SEQ ID NO: 64437

SEQ ID NO: 64440 - protein, 320 aa, Homo sapiens
MYHCHSGSKPTEKGANEYAYAKWKLCSASAICFIFMIAEVVGGHIAGSLAVVTDAAHLLIDLTSFLLSLFSLWLSSKPPSKRLTFGWHRAEILGALLSILCIWVVTGVLVYLACERLLYPDYQIQATVMIIVSSCAVAANIVLTVVLHQRCLGHNHKEVQANASVRAAFVHALGDLFQSISVLISALIIYFKPEYKIADPICTFIFSILVLASTITILKDFSILLMEGVPKSLNYSGVKELILAVDGVLSVHSLHIWSLTMNQVILSAHVATAASRDSQVVRREIAKALSKSFTMHSLTIQMESPVDQDPDCLFCEDPCD

SEQ ID NO: 64441 - protein, 369 aa, Homo sapiens
MEFLERTYLVNDKAAKMYAFTLESVELQQKPVNKDQCPRERPEELESGGMYHCHSGSKPTEKGANEYAYAKWKLCSASAICFIFMIAEVVGGHIAGSLAVVTDAAHLLIDLTSFLLSLFSLWLSSKPPSKRLTFGWHRAEILGALLSILCIWVVTGVLVYLACERLLYPDYQIQATVMIIVSSCAVAANIVLTVVLHQRCLGHNHKEVQANASVRAAFVHALGDLFQSISVLISALIIYFKPEYKIADPICTFIFSILVLASTITILKDFSILLMEGVPKSLNYSGVKELILAVDGVLSVHSLHIWSLTMNQVILSAHVATAASRDSQVVRREIAKALSKSFTMHSLTIQMESPVDQDPDCLFCEDPCD

SEQ ID NO: 64442 - protein, 485 aa, Homo sapiens
MGRYSGKTCRLLFMLVLTVAFFVAELVSGYLGNSIALLSDSFNMLSDLISLCVGLSAGYIARRPTRGFSATYGYARAEVVGALSNAVFLTALCFTIFVEAVLRLARPERIDDPELVLIVGVLGLLVNVVGLLIFQDCAAWFACCLRGRSRRLQQRQQLAEGCVPGAFGGPQGAEDPRRAADPTAPGSDSAVTLRGTSVERKREKGATVFANVAGDSFNTQNEPEDMMKKEKKSEALNIRGVLLHVMGDALGSVVVVITAIIFYVLPLKSEDPCNWQCYIDPSLTVLMVIIILSSAFPLIKETAAILLQMVPKGVNMEELMSKLSAVPGISSVHEVHIWELVSGKIIATLHIKYPKDRGYQDASTKIREIFHHAGIHNVTIQFENVDLKEPLEQKDLLLLCNSPCISKGCAKQLCCPPGALPLAHVNGCAEHNGGPSLDTYGSDGLSRRDAREVAIEVSLDSCLSDHGQSLNKTQEDQCYVNRTHF

SEQ ID NO: 64443 - protein, 240 aa, Homo sapiens
MGDALGSVVVVITAIIFYVLPLKSEDPCNWQCYIDPSLTVLMVIIILSSAFPLIKETAAILLQMVPKGVNMEELMSKLSAVPGISSVHEVHIWELVSGKIIATLHIKYPKDRGYQDASTKIREIFHHAGIHNVTIQFENVDLKEPLEQKDLLLLCNSPCISKGCAKQLCCPPGALPLAHVNGCAEHNGGPSLDTYGSDGLSRRDAREVAIEVSLDSCLSDHGQSLNKTQEDQCYVNRTHF

SEQ ID NO: 64444 - protein, 223 aa, Homo sapiens
MGRYSGKTCRLLFMLVLTVAFFVAELVSGYLGNSIALLSDSFNMLSDLISLCVGLSAGYIARRPTRGFSATYGYARAEVVGALSNAVFLTALCFTIFVEAVLRLARPERIDDPELVLIVGVLGLLVNVVGLLIFQDCAAWFACCLRGRSRRLQQRQQLAEGCVPGAFGGPQGAEDPRRAADPTAPGSDSAVTLRGTSVERKREKGATVFANVAELIHNTRFLL

SEQ ID NO: 64445 - protein, 188 aa, Homo sapiens
MDHSHHMGMSYMDSNSTMQPSHHHPTTSASHSHGGGDSSMMMMPMTFYFGFKNVELLFSGLVINTAGEMAGAFVAVFLLAMFYEGLKIARESLLRKSQVSIRYNSMPVPGPNGTILMETHKTVGQQMLSFPHLLQTCWDYRHEPPHLSLSPSYYSDLNYPKKAKVLLRVSVELMIQEALMITAGDSLC

SEQ ID NO: 64446 - protein, 190 aa, Homo sapiens
MDHSHHMGMSYMDSNSTMQPSHHHPTTSASHSHGGGDSSMMMMPMTFYFGFKNVELLFSGLVINTAGEMAGAFVAVFLLAMFYEGLKIARESLLRKSQVSIRYNSMPVPGPNGTILMETHKTVGQQMLSFPHLLQTVLHIIQVVISYFLMLIFMTYNGYLCIAVAAGAGTGYFLFSWKKAVVVDITEHCH

SEQ ID NO: 64447 - protein, 143 aa, Homo sapiens
MAMHFIFSDTAVLLFDFWSVHSPAGMALSVLVLLLLAVLYEGIKVGKAKLLNQVLVNLPTSISQQTIAETDGDSAGSDSFPVGRTHHRWYLCHFGQSLIHVIQVVIGYFIMLAVMSYNTWIFLGVVLGSAVGYYLAYPLLSTA

SEQ ID NO: 64448 - protein, 549 aa, Homo sapiens
MSPTISHKDSSRQRRPGNFSHSLDMKSGPLPPGGWDDSHLDSAGREGDREALLGDTGTGDFLKAPQSFRAELSSILLLLFLYVLQGIPLGLAGSIPLILQSKNVSYTDQAFFSFVFWPFSLKLLWAPLVDAVYVKNFGRRKSWLVPTQYILGLFMIYLSTQVDRLLGNTDDRTPDVIALTVAFFLFEFLAATQDIAVDGWALTMLSRENVGYASTCNSVGQTAGYFLGNVLFLALESADFCNKYLRFQPQPRGIVTLSDFLFFWGTVFLITTTLVALLKKENEVSVVKEETQGITDTYKLLFAIIKMPAVLTFCLLILTAKIGFSAADAVTGLKLVEEGVPKEHLALLAVPMVPLQIILPLIISKYTAGPQPLNTFYKAMPYRLLLGLEYALLVWWTPKVEHQGGFPIYYYIVVLLSYALHQVTVYSMYVSIMAFNAKVSDPLIGGTYMTLLNTVSNLGGNWPSTVALWLVDPLTVKECVGASNQNCRTPDAVELCKKLGGSCVTALDGYYVESIICVFIGFGWWFFLGPKFKKLQDEGSSSWKCKRNN

SEQ ID NO: 64449 - protein, 549 aa, Homo sapiens; identical to SEQ ID NO: 64448

SEQ ID NO: 64450 - protein, 639 aa, Homo sapiens
MLSYGERLGSPAVSPLPVRGGHVMRGTAFAYVPSPQVLHRIPGTSAYAFPSLGPVALAEHTCPCGEVLERHEPLPAKLALEEEQKPESRLVPKLRQAGAMLLKVPLMLTFLYLFVCSLDMLSSAFQLAGGKVAGDIFKDNAILSNPVAGLVVGILVTVLVQSSSTSTSIIVSMVSSGLLEVSSAIPIIMGSNIGTSVTNTIVALMQAGDRTDFRRAFAGATVHDCFNWLSVLVLLPLEAATGYLHHITRLVVASFNIHGGRDAPDLLKIITEPFTKLIIQLDESVITSIATGDESLRNHSLIQIWCHPDSLQAPTSMSRAEANSSQTLGNATMEKCNHIFVDTGLPDLAVGLILLAGSLVLLCTCLILLVKMLNSLLKGQVAKVIQKVINTDFPAPFTWVTGYFAMVVGASMTFVVQSSSVFTSAITPLIGLGVISIERAYPLTLGSNIGTTTTAILAALASPREKLSSAFQIALCHFFFNISGILLWYPVPCTRLPIRMAKALGKRTAKYRWFAVLYLLVCFLLLPSLVFGISMAGWQVMVGVGTPFGALLAFVVLINVLQSRSPGHLPKWLQTWDFLPRWMHSLKPLDHLITRATLCCARPEPRSPPLPPRVFLEELPPATPSPRLALPAHHNATRL

SEQ ID NO: 64451 - protein, 109 aa, Homo sapiens
MLSYGERLGSPAVSPLPVRGGHVMRGTAFAYVPSPQVLHRIPGTSAYAFPSLGPVALAEHTCPCGEVLERHEPLPAKLALEEEQKPESRLVPKLRQAGAMLLKVPLMLT

SEQ ID NO: 64452 - protein, 340 aa, Homo sapiens
MLSYGERLGSPAVSPLPVRGGHVMRGTAFAYVPSPQVLHRIPGTSAYAFPSLGPVALAEHTCPCGEVLERHEPLPAKLALEEEQKPESRLVPKLRQAGAMLLKVPLMLTFLYLFVCSLDMLSSAFQLAGGKVAGDIFKDNAILSNPVAGLVVGILVTVLVQSSSTSTSIIVSMVSSGLLEVSSAIPIIMGSNIGTSVTNTIVALMQAGDRTDFRRAFAGATVHDCFNWLSVLVLLPLEAATGYLHHITRLVVASFNIHGGRDAPDLLKIITEPFTKLIIQLDESVITSIATGDESLRNHSLIQIWCHPDSLQQNLEGREITHFDLRKKQAMEDSSVPHCP

SEQ ID NO: 64453 - protein, 690 aa, Homo sapiens
MAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCDCPKCCRCSKCCEDLEEAQEGQDVPVKAPETFDNITISREAQGEVPASDSKTECTAL

SEQ ID NO: 64454 - protein, 689 aa, Homo sapiens
MAPWPELGDAQPNPDKYLEGAAGQQPTAPDKSKETNKNNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCDCPKCCRCSKCCEDLEEAQEGQDVPVKAPETFDNITISREAQGEVPASDSKTECTAL

SEQ ID NO: 64455 - protein, 689 aa, Homo sapiens; identical to SEQ ID NO: 64454

SEQ ID NO: 64456 - protein, 161 aa, Homo sapiens
MAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSS

SEQ ID NO: 64457 - protein, 163 aa, Homo sapiens
MAPWPELGDAQPNPDKYLEGAAGQQPTAPDKSKETNKNNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTST

SEQ ID NO: 64458 - protein, 599 aa, Homo sapiens
MPSSLPGSQVPHPTLDAVDLVEKTLRNEGTSSSAPVLEEGDTDPWTLPQLKDTSQPWKELRVAGRLRRVAGSVLKACGLLGSLYFFICSLDVLSSAFQLLGSKVAGDIFKDNVVLSNPVAGLVIGVLVTALVQSSSTSSSIVVSMVAAKLLTVRVSVPIIMGVNVGTSITSTLVSMAQSGDRDEFQRAFSGSAVHGIFNWLTVLVLLPLESATALLERLSELALGAASLTPRAQAPDILKVLTKPLTHLIVQLDSDMIMSSATGNATNSSLIKHWCGTTGQPTQENSSCGAFGPCTEKNSTAPADRLPCRHLFAGTELTDLAVGCILLAGSLLVLCGCLVLIVKLLNSVLRGRVAQVVRTVINADFPFPLGWLGGYLAVLAGAGLTFALQSSSVFTAAVVPLMGVGVISLDRAYPLLLGSNIGTTTTALLAALASPADRMLSALQVALIHFFFNLAGILLWYLVPALRLPIPLARHFGVVTARYRWVAGVYLLLGFLLLPLAAFGLSLAGGMELAAVGGPLVGLVLLVILVTVLQRRRPAWLPVRLRSWAWLPVWLHSLEPWDRLVTRCCPCNVCSPPKATTKEAYCYENPEILASQQL

SEQ ID NO: 64459 - protein, 599 aa, Homo sapiens; identical to SEQ ID NO: 64458

SEQ ID NO: 64460 - protein, 189 aa, Homo sapiens
MTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVEYILKKFKEFRYFSLGEKHSNVSIRDYCDISWRLLVRWS

SEQ ID NO: 64461 - protein, 337 aa, Homo sapiens
MAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 64462 - protein, 278 aa, Homo sapiens
MAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAVLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 64463 - protein, 189 aa, Homo sapiens
MAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVFLQVLVASTLLLWLSTQTTS

SEQ ID NO: 64464 - protein, 178 aa, Homo sapiens
MAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQKKDFSMVTHIMSGLSSVSIQELKVLSRSFIFFLS

SEQ ID NO: 64465 - protein, 203 aa, Homo sapiens
MLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 64466 - protein, 396 aa, Homo sapiens
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKLLTKVKGS

SEQ ID NO: 64467 - protein, 163 aa, Homo sapiens
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVSPKPSMAPEELTGLGTGVWE

SEQ ID NO: 64468 - protein, 218 aa, Homo sapiens
MKLCRDAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQPSPRCSQSHSLCLCLRLRALRSPAASRAATTTAAVFPPWRPHHGALSAKVSAGEVRAGSNGGTQGRGTGVEGVGHLQDPSRHPPGPGSSGFGRWSFLPGH

SEQ ID NO: 64469 - protein, 393 aa, Homo sapiens
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKSVLVK

SEQ ID NO: 64470 - protein, 224 aa, Homo sapiens
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQPSPRCSQSHSLCLCLRLRALRSPAASRAATTTAAVFPPWRPHHGALSAKVAHQGEGFLAAGIEDIGLASFSLLALGPAGTKL

SEQ ID NO: 64471 - protein, 332 aa, Homo sapiens
MAAVGAGGSTAAPGPGAVSAGALEPGTASAGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKSVLVK

SEQ ID NO: 64472 - protein, 242 aa, Homo sapiens
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQPSPRCSQSHSLCLCLRLRALRSPAASRAATTTAAVFPPWRPHHGALSAKVSAGEVRAGSNGGTQGRGTGVEGVGHLQDPSRHPPGPGSSGFGRWSFLPGH

SEQ ID NO: 64473 - protein, 176 aa, Homo sapiens
MAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLV

SEQ ID NO: 64474 - protein, 421 aa, Homo sapiens
MAAVGAGGSTAAPGPGAVSAGALEPGTASAELLLTWEEAEARGQGLPQPLPDTSVRIPAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKSVLVK

SEQ ID NO: 64475 - protein, 355 aa, Homo sapiens
MAEVHRRQHARVKGEAPAKSSTLRDEEELGMASAETLTVFLKLLAAGFYGVSSFLIVVVNKSVLTNYRFPSSLCVGLGQMVATVAVLWVGKALRVVKFPDLDRNVPRKTFPLPLLYFGNQITGLFSTKKLNLPMFTVLRRFSILFTMFAEGVLLKKTFSWGIKMTVFAMIIGAFVAASSDLAFDLEGYAFILINDVLTAANGAYVKQKLDSKELGKYGLLYYNALFMILPTLAIAYFTGDAQKAVEFEGWADTLFLLQFTLSCVMGFILMYATVLCTQYNSALTTTIVGCIKNILITYIGMVFGGDYIFTWTNFIGLNISIAGSLVYSYITFTEEQLSKQSEANNKLDIKGKGAV

SEQ ID NO: 64476 - protein, 260 aa, Homo sapiens
MVATVAVLWVGKALRVVKFPDLDRNVPRKTFPLPLLYFGNQITGLFSTKKLNLPMFTVLRRFSILFTMFAEGVLLKKTFSWGIKMTVFAMIIGAFVAASSDLAFDLEGYAFILINDVLTAANGAYVKQKLDSKELGKYGLLYYNALFMILPTLAIAYFTGDAQKAVEFEGWADTLFLLQFTLSCVMGFILMYATVLCTQYNSALTTTIVGCIKNILITYIGMVFGGDYIFTWTNFIGLNISCICHRGLCELRVGSATLGG

SEQ ID NO: 64477 - protein, 367 aa, Homo sapiens
MSSRSVLSPVVGTDAPDQHLELKKPQELKEMERLPLANEDKTMFANLKYVSLGILVFQTTSLVLTMRYSRTLKEEGPRYLSSTAVVVAELLKIMACILLVYKDSKCSLRALNRVLHDEILNKPMETLKLAIPSGIYTLQNNLLYVALSNLDAATYQVTYQLKILTTALFSVSMLSKKLGVYQWLSLVILMTGVAFVQWPSDSQLDSKELSAGSQFVGLMAVLTACFSSGFAGVYFEKILKETKQSVWIRNIQLGFFGSIFGLMGVYIYDGELVSKNGFFQGYNRLTWIVVVLQALGGLVIAAVIKYADNILKGFATSLSIILSTLISYFWLQDFVPTSVFFLGAILVITATFLYGYDPKPAGNPTKA

SEQ ID NO: 64478 - protein, 325 aa, Homo sapiens
MFANLKYVSLGILVFQTTSLVLTMRYSRTLKEEGPRYLSSTAVVVAELLKIMACILLVYKDSKCSLRALNRVLHDEILNKPMETLKLAIPSGIYTLQNNLLYVALSNLDAATYQVTYQLKILTTALFSVSMLSKKLGVYQWLSLVILMTGVAFVQWPSDSQLDSKELSAGSQFVGLMAVLTACFSSGFAGVYFEKILKETKQSVWIRNIQLGFFGSIFGLMGVYIYDGELVSKNGFFQGYNRLTWIVVVLQALGGLVIAAVIKYADNILKGFATSLSIILSTLISYFWLQDFVPTSVFFLGAILVITATFLYGYDPKPAGNPTKA

SEQ ID NO: 64479 - protein, 224 aa, Homo sapiens
MFANLKYVSLGILVFQTTSLVLTMRYSRTLKEEGPRYLSSTAVVVAELLKIMACILLVYKDSKCSLRALNRVLHDEILNKPMETLKLAIPSGIYTLQNNLLYVALSNLDAATYQVTYQLKILTTALFSVSMLSKKLGVYQWLSLVILMTGVAFVQWPSDSQLDSKELSAGSQFVGLMAVLTACFSSGFAGVYFEKILKETKQSVWIRNIQLGFFGSIFGLMGVY

SEQ ID NO: 64480 - protein, 325 aa, Homo sapiens; identical to SEQ ID NO: 64478

SEQ ID NO: 64481 - protein, 220 aa, Homo sapiens
MFANLKYVSLGILVFQTTSLVLTMRYSRTLKEEGPRYLSSTAVVVAELLKIMACILLVYKDSKCSLRALNRVLHDEILNKPMETLKLAIPSGIYTLQNNLLYVALSNLDAATYQVTYQLKILTTALFSVSMLSKKLGVYQWLSLVILMTGVAFVQWPSDSQLDSKELSAGSQFVGLMAVLTACFSSGFAGVYFEKILKETKQSVWIRNIQLVSFSLEPSL

SEQ ID NO: 64482 - protein, 85 aa, Homo sapiens
MFANLKYVSLGILVFQTTSLVLTMRYSRTLKEEGPRYLSSTAVVVAELLKIMACILLVYKDSKCSLRALNRVLHDEILNKPMETL

SEQ ID NO: 64483 - protein, 367 aa, Homo sapiens; identical to SEQ ID NO: 64477

SEQ ID NO: 64484 - protein, 322 aa, Homo sapiens
MASSSSLVPDRLRLPLCFLGVFVCYFYYGILQEKITRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 64485 - protein, 149 aa, Homo sapiens
PQSCLIGKISRARDQSRGCRFPWPSGMEPRTRVGPLLVLPDACKQPIRPRPWCHSRNTVSSCLGTRGKYGEGAKQETFTFALTLVFIQCVINAVFAKIWWIVPGAGSMLPVLSPIWVPWSPAIQHYSLSTTQLRSLVNPASQSQSCSLG

SEQ ID NO: 64486 - protein, 359 aa, Homo sapiens
MRPLPPVGDVRLELSPPPPLLPVPVVSGSPVGSSGRLMASSSSLVPDRLRLPLCFLGVFVCYFYYGILQEKITRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 64487 - protein, 239 aa, Homo sapiens
MASSSSLVPDRLRLPLCFLGVFVCYFYYGILQEKITRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGESQFCCSSHVSPEGRLPSSF

SEQ ID NO: 64488 - protein, 198 aa, Homo sapiens
MLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 64489 - protein, 189 aa, Homo sapiens
MLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLAMGSCCVA

SEQ ID NO: 64490 - protein, 392 aa, Homo sapiens
MDARWWAVVVLAAFPSLGAGGETPEAPPESWTQLWFFRFVVNAAGYASFMVPGYLLVQYFRRKNYLETGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 64491 - protein, 432 aa, Homo sapiens
MDARWWAVVVLAAFPSLGAGGETPEAPPESWTQLWFFRFVVNAAGYASFMVPGYLLVQYFRRKNYLETGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 64492 - protein, 299 aa, Homo sapiens
MTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 64493 - protein, 339 aa, Homo sapiens
MLLAMPALWYLATSWCSTSGGRTTWRPVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 64494 - protein, 283 aa, Homo sapiens
MDLTQQAKDIQNITVQETNKNNSESIECSKITMDLKFNNSRKYISITVPSKTQTMSPHIKSVDDVVVLGMNLSKFNKLTQFFICVAGVFVFYLIYGYLQELIFSVEGFKSCGWYLTLVQFAFYSIFGLIELQLIQDKRRRIPGKTYMIIAFLTVGTMGLSNTSLGYLNYPTQVIFKCCKLIPVMLGGVFIQGKRYNVADVSAAICMSLGLIWFTLADSTTAPNFNLTGVVLISLALCADAVIGNVQEKAMKLHNASNSEMNITTSSYSGVFIFPNKLKIPLVL

SEQ ID NO: 64495 - protein, 401 aa, Homo sapiens
MDLTQQAKDIQNITVQETNKNNSESIECSKITMDLKFNNSRKYISITVPSKTQTMSPHIKSVDDVVVLGMNLSKFNKLTQFFICVAGVFVFYLIYGYLQELIFSVEGFKSCGWYLTLVQFAFYSIFGLIELQLIQDKRRRIPGKTYMIIAFLTVGTMGLSNTSLGYLNYPTQVIFKCCKLIPVMLGGVFIQGKRYNVADVSAAICMSLGLIWFTLADSTTAPNFNLTGVVLISLALCADAVIGNVQEKAMKLHNASNSEMVLYSYSIGFVYILLGLTCTSGLGPAVTFCAKNPVRTYGYAFLFSLTGYFGISFVLALIKIFGALIAVTVTTGRKAMTIVLSFIFFAKPFTFQYVWSGLLVVLGIFLNVYSKNMDKIRLPSLYDLINKSVEARKSRTLAQTV

SEQ ID NO: 64496 - protein, 218 aa, Homo sapiens [sequence omitted]

SEQ ID NO: 64497 - protein, 331 aa, Homo sapiens
MRPALAVGLVFAGCCSNVIFLELLARKHPGCGNIVTFAQFLFIAVEGFLFEADLGRKPPAIPIRYYAIMVTMFFTVSVVNNYALNLNIAMPLHMIFRSGSLIANMILGIIILKKRYSIFKYTSIALVSVGIFICTFMSAKQVTSQSSLSENDGFQAFVWWLLGIGALTFALLMSARMGIFQETLYKRFGKHSKEALFYNHALPLPGFVFLASDIYDHAVLFNKSELYEIPVIGVTLPIMWFYLLMNIITQYVCIRGVFILTTECASLTVTLVVTLRKFVSLIFSILYFQNPFTLWHWLGTLFVFIGTLMYTEVWNNLGTTKSEPQKDSKKN

SEQ ID NO: 64498 - protein, 364 aa, Homo sapiens
MNRAPLKRSRILHMALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGGFWLGVDQEGAEGTLSWLGTVFGVLASLCVSLNAIYTTKVLPAVDGSIWRLTFYNNVNACILFLPLLLLLGELQALRDFAQLGSAHFWGMMTLGGLFGFAIGYVTGLQIKFTSPLTHNVSGTAKACAQTVLAVLYYEETKSFLWWTSNMMVLGGSSAYTWVRGWEMKKTPEEPSPKDSEKSAMGV

SEQ ID NO: 64499 - protein, 351 aa, Homo sapiens
MALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGGFWLGVDQEGAEGTLSWLGTVFGVLASLCVSLNAIYTTKVLPAVDGSIWRLTFYNNVNACILFLPLLLLLGELQALRDFAQLGSAHFWGMMTLGGLFGFAIGYVTGLQIKFTSPLTHNVSGTAKACAQTVLAVLYYEETKSFLWWTSNMMVLGGSSAYTWVRGWEMKKTPEEPSPKDSEKSAMGV

SEQ ID NO: 64500 - protein, 351 aa, Homo sapiens; identical to SEQ ID NO: 64499

SEQ ID NO: 64501 - protein, 72 aa, Homo sapiens
MALTGASDPSAEAEANGEKPFLLRALQIALVVSLYWVTSISMVFLNKYLLDSPSLRLDTPIFVTFYQCLVTT

SEQ ID NO: 64502 - protein, 165 aa, Homo sapiens
MALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIII

SEQ ID NO: 64503 - protein, 246 aa, Homo sapiens
MNRAPLKRSRILHMALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGGFWLGVDQEGAEGTLSWLGTVFGVLASLCVSLNAIYTTKVLPAVDGSIWRLTFYNNVNACILFLPLL

SEQ ID NO: 64504 - protein, 337 aa, Homo sapiens
MTAGGQAEAEGAGGEPGAARLPSRVARLLSALFYGTCSFLIVLVNKALLTTYGFPSPIFLGIGQMAATIMILYVSKLNKIIHFPDFDKKIPVKLFPLPLLYVGNHISGLSSTSKLSLPMFTVLRKFTIPLTLLLETIILGKQYSLNIILSVFAIILGAFIAAGSDLAFNLEGYIFVFLNDIFTAANGVYTKQKMDPKELGKYGVLFYNACFMIIPTLIISVSTGDLQQATEFNQWKNVVFILQFLLSCFLGFLLMYSTVLCSYYNSALTTAVVGAIKNVSVAYIGILIGGDYIFSLLNFVGLNICMAGGLRYSFLTLSSQLKPKPVGEENICLDLKS

SEQ ID NO: 64505 - protein, 163 aa, Homo sapiens
MTAGGQAEAEGAGGEPGAARLPSRVARLLSALFYGTCSFLIVLVNKALLTTYGFPSPIFLGIGQMAATIMILYVSKLNKIIHFPDFDKKIPVKLFPLPLLYVGNHISGLSSTSKLSLPMFTVLRKFTIPLTLLLETIILGKQYSLNIILSVFAIILGAFIAAG

SEQ ID NO: 64506 - protein, 249 aa, Homo sapiens
MTAGGQAEAEGAGGEPGAARLPSRVARLLSALFYGTCSFLIVLVNKALLTTYGFPSPIFLGIGQMAATIMILYVSKLNKIIHFPDFDKKIPVKLFPLPLLYVGNHISGLSSTSKLSLPMFTVLRKFTIPLTLLLETIILGKQYSLNIILSVFAIILGAFIAAGFLLMYSTVLCSYYNSALTTAVVGAIKNVSVAYIGILIGGDYIFSLLNFVGLNICMAGGLRYSFLTLSSQLKPKPVGEENICLDLKS

SEQ ID NO: 64507 - protein, 416 aa, Homo sapiens
MRQLCRGRVLGISVAIAHGVFSGSLNILLKFLISRYQFSFLTLVQCLTSSTAALSLELLRRLGLIAVPPFGLSLARSFAGVAVLSTLQSSLTLWSLRGLSLPMYVVFKRCLPLVTMLIGVLVLKNGAPSPGVLAAVLITTCGAALAGAGDLTGDPIGYVTGVLAVLVHAAYLVLIQKASADTEHGPLTAQYVIAVSATPLLVICSFASTDSIHAWTFPGWKDPAMVCIFVACILIGCAMNFTTLHCTYINSAVTTSFVGVVKSIATITVGMVAFSDVEPTSLFIAGVVVNTLGSIIYCVAKFMETRKQSNYEDLEAQPRGEEAQLSGDQLPFVMEELPGEGGNGRSEGGEAAGGPAQESRQEVRGSPRGVPLVAGSSEEGSRRSLKDAYLEVWRLVRGTRYMKKDYLIENEELPSP

SEQ ID NO: 64508 - protein, 476 aa, Homo sapiens
MSTQRLRNEDYHDYSSTDVSPEESPSEGLNNLSSPGSYQRFGQSNSTTWFQTLIHLLKGNIGTGLLGLPLAVKNAGIVMGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQRIPDPSHLPLVAPWKTYPLFFGTAIFSFEGIGMVLPLENKMKDPRKFPLILYLGMVIVTILYISLGCLGYLQFGANIQGSITLNLPNCWLYQSVKLLYSIGIFFTYALQFYVPAEIIIPFFVSRAPEHCELVVDLFVRTVLVCLTCILAILIPRLDLVISLVGSVSSSALALIIPPLLEVTTFYSEGMSPLTIFKDALISILGFVGFVVGTYEALYELIQPSNAPIFINSTCAFI

SEQ ID NO: 64509 - protein, 386 aa, Homo sapiens
MSTQRLRNEDYHDYSSTDVSPEESPSEGLNNLSSPGSYQRFGQSNSTTWFQTLIHLLKGNIGTGLLGLPLAVKNAGIVMGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQRIPDPSHLPLVAPWKTYPLFFGTAIFSFEGIGMVLPLENKMKDPRKFPLILYLGMVIVTILYISLGCLGYLQFGANIQGSITLNLPNCWLYQSVKLLYSIGIFFTYALQFYVPAEIIIPFFVSRAPEHCELVVDLFVRTVLVCLT

SEQ ID NO: 64510 - protein, 70 aa, Homo sapiens
MSTQRLRNEDYHDYSSTDVSPEESPSEGLNNLSSPGSYQRFGQSNSTTWFQTLIHLLKGNIGTGLLGLPL

SEQ ID NO: 64511 - protein, 72 aa, Homo sapiens
MSTQRLRNEDYHDYSSTDVSPEESPSEGLNNLSSPGSYQRFGQSNSTTWFQTLIHLLKGNIGTGLLGLPLAV

SEQ ID NO: 64512 - protein, 476 aa, Homo sapiens; identical to SEQ ID NO: 64508

SEQ ID NO: 64513 - protein, 388 aa, Homo sapiens
MSTQRLRNEDYHDYSSTDVSPEESPSEGLNNLSSPGSYQRFGQSNSTTWFQTLIHLLKGNIGTGLLGLPLAVKNAGIVMGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQRIPDPSHLPLVAPWKTYPLFFGTAIFSFEGIGMVLPLENKMKDPRKFPLILYLGMVIVTILYISLGCLGYLQFGANIQGSITLNLPNCWLYQSVKLLYSIGIFFTYALQFYVPAEIIIPFFVSRAPEHCELVVDLFVRTVLVCLTCE

SEQ ID NO: 64514 - protein, 483 aa, Homo sapiens
MSVTKSTEGPQGAVAIKLDLMSPPESAKKLENKDSTFLDESPSESAGLKKTKGITVFQALIHLVKGNMGTGILGLPLAVKNAGILMGPLSLLVMGFIACHCMHILVKCAQRFCKRLNKPFMDYGDTVMHGLEANPNAWLQNHAHWGRHIVSFFLIITQLGFCCVYIVFLADNLKQVVEAVNSTTNNCYSNETVILTPTMDSRLYMLSFLPFLVLLVLIRNLRILTIFSMLANISMLVSLVIIIQYITQEIPDPSRLPLVASWKTYPLFFGTAIFSFESIGVVLPLENKMKNARHFPAILSLGMSIVTSLYIGMAALGYLRFGDDIKASISLNLPNCWLYQSVKLLYIAGILCTYALQFYVPAEIIIPFAISRVSTRWALPLDLSIRLVMVCLTCLLAILIPRLDLVISLVGSVSGTALALIIPPLLEVTTFYSEGMSPLTIFKDALISILGFVGFVVGTYQALDELLKSEDSHPFSNSTTFVR

SEQ ID NO: 64515 - protein, 207 aa, Homo sapiens
MNDTAVLPLENKMKNARHFPAILSLGMSIVTSLYIGMAALGYLRFGDDIKASISLNLPNCWLYQSVKLLYIAGILCTYALQFYVPAEIIIPFAISRVSTRWALPLDLSIRLVMVCLTCLLAILIPRLDLVISLVGSVSGTALALIIPPLLEVTTFYSEGMSPLTIFKDALISILGFVGFVVGTYQALDELLKSEDSHPFSNSTTFVR

SEQ ID NO: 64516 - protein, 470 aa, Homo sapiens
MSLLGRDYNSELNSLDNGPQSPSESSSSITSENVHPAGEAGLSMMQTLIHLLKCNIGTGLLGLPLAIKNAGLLVGPVSLLAIGVLTVHCMVILLNCAQHLSQRLQKTFVNYGEATMYGLETCPNTWLRAHAVWGRYTVSFLLVITQLGFCSVYFMFMADNLQQMVEKAHVTSNICQPREILTLTPILDIRFYMLIILPFLILLVFIQNLKVLSVFSTLANITTLGSMALIFEYIMEGIPYPSNLPLMANWKTFLLFFGTAIFTFEGVGMVLPLKNQMKHPQQFSFVLYLGMSIVIILYILLGTLGYMKFGSDTQASITLNLPNCWLYQSVKLMYSIGIFFTYALQFHVPAEIIIPFAISQVSESWALFVDLSVRSALVCLTCVSAILIPRLDLVISLVGSVSSSALALIIPALLEIVIFYSEDMSCVTIAKDIMISIVGLLGCIFGTYQALYELPQPISHSMANSTGVHA

SEQ ID NO: 64517 - protein, 511 aa, Homo sapiens
MSLLGRDYNSELNSLDNGPQSPSESSSSITSENVHPAGEAGLSMMQTLIHLLKCNIGTGLLGLPLAIKNAGLLVGPVSLLAIGVLTVHCMVILLNCAQHLSQRLQKTFVNYGEATMYGLETCPNTWLRAHAVWGRWNLALSPRLECSGKISAHCNPHLQGSSNSPAQASRVAGIYRYTVSFLLVITQLGFCSVYFMFMADNLQQMVEKAHVTSNICQPREILTLTPILDIRFYMLIILPFLILLVFIQNLKVLSVFSTLANITTLGSMALIFEYIMEGIPYPSNLPLMANWKTFLLFFGTAIFTFEGVGMVLPLKNQMKHPQQFSFVLYLGMSIVIILYILLGTLGYMKFGSDTQASITLNLPNCWLYQSVKLMYSIGIFFTYALQFHVPAEIIIPFAISQVSESWALFVDLSVRSALVCLTCVSAILIPRLDLVISLVGSVSSSALALIIPALLEIVIFYSEDMSCVTIAKDIMISIVGLLGCIFGTYQALYELPQPISHSMANSTGVHA

SEQ ID NO: 64518 - protein, 504 aa, Homo sapiens
MEAAATPAAAGAARREELDMDVMRPLINEQNFDGTSDEEHEQELLPVQKHYQLDDQEGISFVQTLMHLLKGNIGTGLLGLPLAIKNAGIVLGPISLVFIGIISVHCMHILVRCSHFLCLRFKKSTLGYSDTVSFAMEVSPWSCLQKQAAWGRSVVDFFLVITQLGFCSVYIVFLAENVKQVHEGFLESKVFISNSTNSSNPCERRSVDLRIYMLCFLPFIILLVFIRELKNLFVLSFLANVSMAVSLVIIYQYVVRNMPDPHNLPIVAGWKKYPLFFGTAVFAFEGIGVVLPLENQMKESKRFPQALNIGMGIVTTLYVTLATLGYMCFHDEIKGSITLNLPQDVWLYQSVKILYSFGIFVTYSIQFYVPAEIIIPGITSKFHTKWKQICEFGIRSFLVSITCAGAILIPRLDIVISFVGAVSSSTLALILPPLVEILTFSKEHYNIWMVLKNISIAFTGVVGFLLGTYITVEEIIYPTPKVVAGTPQSPFLNLNSTCLTSGLK

SEQ ID NO: 64519 - protein, 533 aa, Homo sapiens
MARLPAGIRFIISFSRDQWYRAFIFILTFLLYASFHLSRKPISIVKGELHKYCTAWDEADVRFSSQNRKSGSAAPHQLPDNETDCGWAPFDKNNYQQLLGALDYSFLCAYAVGMYLSGIIGERLPIRYYLTFGMLASGAFTALFGLGYFYNIHSFGFYVVTQVINGLVQTTGWPSVVTCLGNWFGKGRRGLIMGVWNSHTSVGNILGSLIAGYWVSTCWGLSFVVPGAIVAAMGIVCFLFLIEHPNDVRCSSTLVTHSKGYENGTNRLRLQKQILKSEKNKPLDPEMQCLLLSDGKGSIHPNHVVILPGDGGSGTAAISFTGALKIPGVIEFSLCLLFAKLVSYTFLFWLPLYITNVDHLDAKKAGELSTLFDVGGIFGGILAGVISDRLEKRASTCGLMLLLAAPTLYIFSTVSKMGLEATIAMLLLSGALVSGPYTLITTAVSADLGTHKSLKGNAHALSTVTAIIDGTGSVGAALGPLLAGLLSPSGWSNVFYMLMFADACALLFLIRLIHKELSCPGSATGDQVPFKEQ

SEQ ID NO: 64520 - protein, 533 aa, Homo sapiens; identical to SEQ ID NO: 64519

SEQ ID NO: 64521 - protein, 18 aa, Homo sapiens
MARLPAGIRFIISFSRDQ

SEQ ID NO: 64522 - protein, 18 aa, Homo sapiens
MARLPAGIRFIISFSRDQ

SEQ ID NO: 64523 - protein, 487 aa, Homo sapiens
MMHFKSGLELTELQNMTVPEDDNISNDSNDFTEVENGQINSKFISDRESRRSLTNSHLEKKKCDEYIPGTTSLGMSVFNLSNAIMGSGILGLAFALANTGILLFLVLLTSVTLLSIYSINLLLICSKETGCMVYEKLGEQVFGTTGKFVIFGATSLQNTGAMLSYLFIVKNELPSAIKFLMGKEETFSAWYVDGRVLVVIVTFGIILPLCLLKNLGYLGYTSGFSLSCMVFFLIVVIYKKFQIPCIVPELNSTISANSTNADTCTPKYVTFNSKTVYALPTIAFAFVCHPSVLPIYSELKDRSQKKMQMVSNISFFAMFVMYFLTAIFGYLTFYDNVQSDLLHKYQSKDDILILTVRLAVIVAVILTVPVLFFTVRSSLFELAKKTKFNLCRHTVVTCILLVVINLLVIFIPSMKDIFGVVGVTSANMLIFILPSSLYLKITDQDGDKGTQRIWAALFLGLGVLFSLVSIPLVIYDWACSSSSDEGH

SEQ ID NO: 64524 - protein, 487 aa, Homo sapiens; identical to SEQ ID NO: 64523

SEQ ID NO: 64525 - protein, 487 aa, Homo sapiens; identical to SEQ ID NO: 64523

SEQ ID NO: 64526 - protein, 487 aa, Homo sapiens; identical to SEQ ID NO: 64523

SEQ ID NO: 64527 - protein, 506 aa, Homo sapiens
MKKAEMGRFSISPDEDSSSYSSNSDFNYSYPTKQAALKSHYADVDPENQNFLLESNLGKKKYETEFHPGTTSFGMSVFNLSNAIVGSGILGLSYAMANTGIALFIILLTFVSIFSLYSVHLLLKTANEGGSLLYEQLGYKAFGLVGKLAASGSITMQNIGAMSSYLFIVKYELPLVIQALTNIEDKTGLWYLNGNYLVLLVSLVVILPLSLFRNLGYLGYTSGLSLLCMVFFLIVVICKKFQVPCPVEAALIINETINTTLTQPTALVPALSHNVTENDSCRPHYFIFNSQTVYAVPILIFSFVCHPAVLPIYEELKDRSRRRMMNVSKISFFAMFLMYLLAALFGYLTFYEHVESELLHTYSSILGTDILLLIVRLAVLMAVTLTVPVVIFPIRSSVTHLLCASKDFSWWRHSLITVSILAFTNLLVIFVPTIRDIFGFIGASAASMLIFILPSAFYIKLVKKEPMKSVQKIGALFFLLSGVLVMTGSMALIVLDWVHNAPGGGH

SEQ ID NO: 64528 - protein, 547 aa, Homo sapiens
MDPMELRNVNIEPDDESSSGESAPDSYIGIGNSEKAAMSSQFANEDTESQKFLTNGFLGKKKLADYADEHHPGTTSFGMSSFNLSNAIMGSGILGLSYAMANTGIILFIIMLLAVAILSLYSVHLLLKTAKEGGSLIYEKLGEKAFGWPGKIGAFVSITMQNIGAMSSYLFIIKYELPEVIRAFMGLEENTGEWYLNGNYLIIFVSVGIILPLSLLKNLGYLGYTSGFSLTCMVFFVSVVIYKKFQIPCPLPVLDHSVGNLSFNNTLPMHVVMLPNNSESSDVNFMMDYTHRNPAGLDENQAKGSLHDSGVEYEAHSDDKCEPKYFVFNSRTAYAIPILVFAFVCHPEVLPIYSELKDRSRRKMQTVSNISITGMLVMYLLAALFGYLTFYGEVEDELLHAYSKVYTLDIPLLMVRLAVLVAVTLTVPIVLFPIRTSVITLLFPKRPFSWIRHFLIAAVLIALNNVLVILVPTIKYIFGFIGASSATMLIFILPAVFYLKLVKKETFRSPQKVGALIFLVVGIFFMIGSMALIIIDWIYDPPNSKHH

SEQ ID NO: 64529 - protein, 259 aa, Homo sapiens
MDPMELRNVNIEPDDESSSGESAPDSYIGIGNSEKAAMSSQFANEDTESQKFLTNGFLGKKKLADYADEHHPGTTSFGMSSFNLSNAIMGSGILGLSYAMANTGIILFIIMLLAVAILSLYSVHLLLKTAKEGGSLIYEKLGEKAFGWPGKIGAFVSITMQNIGAMSSYLFIIKYELPEVIRAFMGLEENTGEWYLNGNYLIIFVSVGIILPLSLLKNLGYLGYTSGFSLTCMVFFVSVMIYKKISFFLQIFIILKLFF

SEQ ID NO: 64530 - protein, 547 aa, Homo sapiens; identical to SEQ ID NO: 64528

SEQ ID NO: 64531 - protein, 192 aa, Homo sapiens
MDPMELRNVNIEPDDESSSGESAPDSYIGIGNSEKAAMSSQFANEDTESQKFLTNGFLGKKKLADYADEHHPGTTSFGMSSFNLSNAIMGSGILGLSYAMANTGIILFIIMLLAVAILSLYSVHLLLKTAKEGGSLIYEKLGEKAFGWPGKIGAFVSITMQNIGAMSSYLFIIKYELPEVIRAFMGLEENTG

SEQ ID NO: 64532 - protein, 219 aa, Homo sapiens
MDPMELRNVNIEPDDESSSGESAPDSYIGIGNSEKAAMSSQFANEDTESQKFLTNGFLGKKKLADYADEHHPGTTSFGMSSFNLSNAIMGSGILGLSYAMANTGIILFIIMLLAVAILSLYSVHLLLKTAKEGGSLIYEKLGEKAFGWPGKIGAFVSITMQNIGAMSSYLFIIKYELPEVIRAFMGLEENTGEWYLNGNYLIIFVSVGIILPLSLLKNL

SEQ ID NO: 64533 - protein, 472 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRMSGH

SEQ ID NO: 64534 - protein, 421 aa, Homo sapiens
MSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRMSGH

SEQ ID NO: 64535 - protein, 472 aa, Homo sapiens; identical to SEQ ID NO: 64533

SEQ ID NO: 64536 - protein, 219 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQL

SEQ ID NO: 64537 - protein, 191 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHL

SEQ ID NO: 64538 - protein, 164 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEG

SEQ ID NO: 64539 - protein, 279 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIY

SEQ ID NO: 64540 - protein, 272 aa, Homo sapiens
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCH

SEQ ID NO: 64541 - protein, 462 aa, Homo sapiens
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTGICGFLTFGAAVDPDVLLSYPSEDMAVAVARAFIILSVLTSYPILHFCGRAVVEGLWLRYQGVPVEEDVGRERRRRVLQTLVWFLLTLLLALFIPDIGKVISVIGGLAACFIFVFPGLCLIQAKLSEMEEVKPASWWVLVSYGVLLVTLGAFIFGQTTANAIFVDLLA

SEQ ID NO: 64542 - protein, 324 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLFIQI

SEQ ID NO: 64543 - protein, 324 aa, Homo sapiens; identical to SEQ ID NO: 64542

SEQ ID NO: 64544 - protein, 324 aa, Homo sapiens; identical to SEQ ID NO: 64542

SEQ ID NO: 64545 - protein, 324 aa, Homo sapiens; identical to SEQ ID NO: 64542

SEQ ID NO: 64546 - protein, 240 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVA

SEQ ID NO: 64547 - protein, 206 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRAR

SEQ ID NO: 64548 - protein, 321 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLF

SEQ ID NO: 64549 - protein, 222 aa, Homo sapiens
MKAQLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLFIQI

SEQ ID NO: 64550 - protein, 313 aa, Homo sapiens
MGPWGEPELLVWRPEAVASEPPVPVGLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLFIQI

SEQ ID NO: 64551 - protein, 364 aa, Homo sapiens
MPGCPCPGCGMAGPRLLFLTALALELLERAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKIGLLTTMAILLHEIPHEVGDFAILLRAGFDRWSAAKLQLSTALGGLLGAGFAICTQSPKGVEETAAWVLPFTSGGFLYIALVNVLPDLLEEEDPWRSLQQLLLLCAGIVVMVLFSLFVD

SEQ ID NO: 64552 - protein, 371 aa, Homo sapiens
MPGCPCPGCGMAGPRLLFLTALALELLERAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKIGLLTTMAILLHEIPHEVGDFAILLRAGFDRWSAAKLQLSTALGGLLGAGFAICTQSPKGVVGCSPAAEETAAWVLPFTSGGFLYIALVNVLPDLLEEEDPWRSLQQLLLLCAGIVVMVLFSLFVD

SEQ ID NO: 64553 - protein, 309 aa, Homo sapiens
MEQLLGIKLGCLFALLALTLGCGLTPICFKWFQIDAARGHHRLVLRLLGCISAGVFLGAGFMHMTAEALEEIESQIQKFMVQNRSASERNSSGDADSAHMEYPYGELIISLGFFFVFFLESLALQCCPGAAGGSTVQDEEWGGAHIFELHSHGHLPSPSKGPLRALVLLLSLSFHSVFEGLAVGLQPTVAATVQLCLAVLAHKGLVVFGVGMRLVHLGTSSRWAVFSILLLALMSPLGLAVGLAVTGGDSEGGRGLAQAVLEGVAAGTFLYVTFLEILPRELASPEAPLAKWSCVAAGFAFMAFIALWA

SEQ ID NO: 64554 - protein, 314 aa, Homo sapiens
MVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGSVASVLLQGLAGGTFLFITFLEILAKELEEKSDRLLKVLFLVLGYTVLAGMVFLKW

SEQ ID NO: 64555 - protein, 105 aa, Homo sapiens
MVKLLVAKILCMVGVFFFMLLGSLLPVKIIETDFEKAHRSKKILSLCNTFGGGVFLATCFNALLPAVREKVRAPWALAAALGTLWPRDSDAFSTLMPSSVKALML

SEQ ID NO: 64556 - protein, 323 aa, Homo sapiens
MVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGSVASVLLQGLAGGTFLFITFLEILAKELEEKSDRLLKVLFLVLGYTVLAGMVFLKWISPPEPRVS

SEQ ID NO: 64557 - protein, 622 aa, Homo sapiens
MVDVVGLERETGPRGSPWPGLPLPSLVGPAPLLTCLCPQCLSVEDALGLGEPEGSGLPPGPVLEARYVARLSAAAVLYLSNPEGTCEDARAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSWDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 64558 - protein, 647 aa, Homo sapiens
MASLVSLELGLLLAVLVVTATASPPAGLLSLLTSGQGALDQEALGGLLNTLADRVHCANGPCGKCLSVEDALGLGEPEGSGLPPGPVLEARYVARLSAAAVLYLSNPEGTCEDARAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSWDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 64559 - protein, 469 aa, Homo sapiens
MARGLGAPHWVAVGLLTWATLGLLVAGLGGHDDLHDDLQEDFHGHSHRHSHEDFHHGHSHAHGHGHTHESIWHGHTHDHDHGHSHEDLHHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTACALLTEGGAVGSEIAGGAGPGWVLPFTAGGFIYVATVSVLPELLREASPLQSLLEVLGLLGGVIMMVLIAHLE

SEQ ID NO: 64560 - protein, 469 aa, Homo sapiens; identical to SEQ ID NO: 64559

SEQ ID NO: 64561 - protein, 469 aa, Homo sapiens; identical to SEQ ID NO: 64559

SEQ ID NO: 64562 - protein, 469 aa, Homo sapiens; identical to SEQ ID NO: 64559

SEQ ID NO: 64563 - protein, 220 aa, Homo sapiens
MDSSLPECRHIGKGIRAKVERNFLFSRDLKAGLPRPSKPGKERIPEPALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEK

SEQ ID NO: 64564 - protein, 220 aa, Homo sapiens; identical to SEQ ID NO: 64563

SEQ ID NO: 64565 - protein, 469 aa, Homo sapiens; identical to SEQ ID NO: 64559

SEQ ID NO: 64566 - protein, 469 aa, Homo sapiens; identical to SEQ ID NO: 64559

SEQ ID NO: 64567 - protein, 469 aa, Homo sapiens; identical to SEQ ID NO: 64559

SEQ ID NO: 64568 - protein, 220 aa, Homo sapiens; identical to SEQ ID NO: 64563

SEQ ID NO: 64569 - protein, 220 aa, Homo sapiens; identical to SEQ ID NO: 64563

SEQ ID NO: 64570 - protein, 469 aa, Homo sapiens; identical to SEQ ID NO: 64559

SEQ ID NO: 64571 - protein, 469 aa, Homo sapiens; identical to SEQ ID NO: 64559

SEQ ID NO: 64572 - protein, 469 aa, Homo sapiens; identical to SEQ ID NO: 64559

SEQ ID NO: 64573 - protein, 469 aa, Homo sapiens; identical to SEQ ID NO: 64559

SEQ ID NO: 64574 - protein, 220 aa, Homo sapiens; identical to SEQ ID NO: 64563

SEQ ID NO: 64575 - protein, 374 aa, Homo sapiens
MARGLGAPHWVAVGLLTWATLGLLVAGLGGHDDLHDDLQEDFHGHSHSADLSSSIFCPLPYPRGVELSPASLSTSDLAQFCFRWAPGRCFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTACALLTEGGAVGSEIAGGAGPGWVLPFTAGGFIYVATVSVLPELLREASPLQSLLEVLGLLGGVIMMVLIAHLE

SEQ ID NO: 64576 - protein, 450 aa, Homo sapiens
MARGLGAPHWVAVGLLTWATLGLLVAGLGGHDDLHDDLQEDFHGHGHTHESIWHGHTHDHDHGHSHEDLHHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTACALLTEGGAVGSEIAGGAGPGWVLPFTAGGFIYVATVSVLPELLREASPLQSLLEVLGLLGGVIMMVLIAHLE

SEQ ID NO: 64577 - protein, 220 aa, Homo sapiens; identical to SEQ ID NO: 64563

SEQ ID NO: 64578 - protein, 469 aa, Homo sapiens; identical to SEQ ID NO: 64559

SEQ ID NO: 64579 - protein, 374 aa, Homo sapiens; identical to SEQ ID NO: 64575

SEQ ID NO: 64580 - protein, 450 aa, Homo sapiens; identical to SEQ ID NO: 64576

SEQ ID NO: 64581 - protein, 374 aa, Homo sapiens; identical to SEQ ID NO: 64575

SEQ ID NO: 64582 - protein, 374 aa, Homo sapiens; identical to SEQ ID NO: 64575

SEQ ID NO: 64583 - protein, 450 aa, Homo sapiens; identical to SEQ ID NO: 64576

SEQ ID NO: 64584 - protein, 450 aa, Homo sapiens; identical to SEQ ID NO: 64576

SEQ ID NO: 64585 - protein, 374 aa, Homo sapiens; identical to SEQ ID NO: 64575

SEQ ID NO: 64586 - protein, 450 aa, Homo sapiens; identical to SEQ ID NO: 64576

SEQ ID NO: 64587 - protein, 450 aa, Homo sapiens; identical to SEQ ID NO: 64576

SEQ ID NO: 64588 - protein, 374 aa, Homo sapiens; identical to SEQ ID NO: 64575

SEQ ID NO: 64589 - protein, 796 aa, Homo sapiens
MLAPLRNAPGREGATSPSPPTDATGSLGEWDVDRNVKTEGWVSKERISKLHRLRMADILSQSETLASQDLSGDFKKPALPVSPAARSKAPASSSSNPEEVQKEGPTALQDSNSGEPDIPPPQPDCGDFRSLQEEQSRPPTAVSSPGGPARAPPYQEPPWGGPATAPYSLETLKGGTILGTRSLKGTSYCLFGRLSGCDVCLEHPSVSRYHAVLQHRASGPDGECDSNGPGFYLYDLGSTHGTFLNKTRIPPRTYCRVHVGHVVRFGGSTRLFILQGPEEDREAESELTVTQLKELRKQQQILLEKKMLGEDSDEEEEMDTSERKINAGSQDDEMGCTWGMGEDAVEDDAEENPIVLEFQQEREAFYIKDPKKALQGFFDREGEELEYEFDEQGHSTWLCRVRLPVDDSTGKQLVAEAIHSGKKKEAMIQCSLEACRILDTLGLLRQEAVSRKRKAKNWEDEDFYDSDDDTFLDRTGLIEKKRLNRMKKAGKIDEKPETFESLVAKLNDAERELSEISERLKASSQVLSESPSQDSLDAFMSEMKSGSTLDGVSRKKLHLRTFELRKEQQRLKGLIKIVKPAEIPELKKTETQTTGAENKAKKLTLPLFGAMKGGSKFKLKTGTVGKLPPKRPELPPTLMRMKDEPEVEEEEEEEEEEEKEKEEHEKKKLEDGSLSRPQPEIEPEAAVQEMRPPTDLTHFKETQTHENMSQLSEEEQNKDYQDCSKTTSLCAGPSASKNEYEKSRGELKKKKTPGPGKLPPTLSSKYPEDDPDYCVWVPPEGQSGDGRTHLNDKYGY

SEQ ID NO: 64590 - protein, 1232 aa, Homo sapiens
MDFLLRPQPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 64591 - protein, 1227 aa, Homo sapiens
MTQPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 64592 - protein, 801 aa, Homo sapiens
VMEVVEAEKIVLLTSARFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 64593 - protein, 747 aa, Homo sapiens
MPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRMESCSVAWLECGGVILAHCNLRLLPSSWDYRHAPPQPANFCIFSRDGVSPCWPGWSQSLDLVICLPRPPKMLGLQA

SEQ ID NO: 64594 - protein, 1044 aa, Homo sapiens
MPAAGSNEPDGVLSYQRPDEEAVVDQGGTSTILNIHYEKEELEGHRTLYVGVRMPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRVRSMVSDFAVFLTIFTMVIIDFLIGVPSPKLQVPSVFKPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFIPMPVLYGVFLYMGVSSLQGIQFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEVIVLAPTVYLGASNYRT

SEQ ID NO: 64595 - protein, 911 aa, Homo sapiens
MEELQDDYEDMMEENLEQEEYEDPDIPESQMEEPAAHDTEATATDYHTTSHPGTHKVYVELQELVMDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPVPIRFLFVLLGPEAPHIDYTQLGRAAATLMSERVFRIDAYMAQSRGELLHSLEGFLDCSLVLPPTDAPSEQALLSLVPVQRELLRRRYQSSPAKPDSSFYKGLDLNGGPDDPLQQTGQLFGGLVRDIRRRYPYYLSDITDAFSPQVLAAVIFIYFAALSPAITFGGLLGEKTRNQMGVSELLISTAVQGILFALLGAQPLLVVGFSGPLLVFEEAFFSFCETNGLEYIVGRVWIGFWLILLVVLVVAFEGSFLVRFISRYTQEIFSFLISLIFIYETFSKLIKIFQDHPLQKTYNYNVLMVPKPQGPLPNTALLSLVLMAGTFFFAMMLRKFKNSSYFPGKLRRVIGDFGVPISILIMVLVDFFIQDTYTQKLSVPDGFKVSNSSARGWVIHPLGLRSEFPIWMMFASALPALLVFILIFLESQITTLIVSKPERKMVKGSGFHLDLLLVVGMGGVAALFGMPWLSATTVRSVTHANALTVMGKASTPGAAAQIQEVKEQRISGLLVAVLVGLSILMEPILSRIPLAVLFGIFLYMGVTSLSGIQLFDRILLLFKPPKYHPDVPYVKRVKTWRMHLFTGIQIICLAVLWVVKSTPASLALPFVLILTVPLRRVLLPLIFRNVELQCLDADDAKATFDEEEGRDEYDEVAMPV

SEQ ID NO: 64596 - protein, 1159 aa, Homo sapiens
MSSAPRRPAKGADSFCTPGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 64597 - protein, 1241 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 64598 - protein, 151 aa, Homo sapiens [sequence omitted]

SEQ ID NO: 64599 - protein, 127 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEED

SEQ ID NO: 64600 - protein, 145 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSP

SEQ ID NO: 64601 - protein, 1241 aa, Homo sapiens; identical to SEQ ID NO: 64597

SEQ ID NO: 64602 - protein, 70 aa, Homo sapiens
MSSAPRRPAKGADSFCTPEPESLGPGTPGFPEQEEDELHRTLGVERFEEILQEAGSRGGEEPGRSYGEED

SEQ ID NO: 64603 - protein, 169 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERT

SEQ ID NO: 64604 - protein, 1079 aa, Homo sapiens
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 64605 - protein, 1035 aa, Homo sapiens
MSTENVEGKPSNLGERGRARSSTFLRVVQPMFNHSIFTSAVSPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 64606 - protein, 995 aa, Homo sapiens
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 64607 - protein, 1094 aa, Homo sapiens
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDEKDHQHSLNATHHADKIPFLQSLGMPSPPRTPVKVVPQIRIELEPEDNDYFWRSKGTETTL

SEQ ID NO: 64608 - protein, 1040 aa, Homo sapiens
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKVRALVADFSIVFSILMFCGIDACFGLETPKLHVPSVIKPTRPDRGWFVAPFGKNPWWVYPASILPALLVTILIFMDQQITAVIVNRKENKLKKAAGYHLDLFWVGILMALCSFMGLPWYVAATVISIAHIDSLKMETETSAPGEQPQFLGVREQRVTGIIVFILTGISVFLAPILKILGLIIVRRLLDFIFSQHDLAWIDNILPEKEKKETDKKRKRKKGAHEDCDEEPQFPPPSVIKIPMESVQSDPQNGIHCIARKRSSSWSYSL

SEQ ID NO: 64609 - protein, 1137 aa, Homo sapiens
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKVRALVADFSIVFSILMFCGIDACFGLETPKLHVPSVIKPTRPDRGWFVAPFGKNPWWVYPASILPALLVTILIFMDQQITAVIVNRKENKLKKAAGYHLDLFWVGILMALCSFMGLPWYVAATVISIAHIDSLKMETETSAPGEQPQFLGVREQRVTGIIVFILTGISVFLAPILKCIPLPVLYGVFLYMGVASLNGIQMGTGGSEFKIQKKLTPFWERCKLFLMPAKHQPDHAFLRHVPLRRIHLFTLVQILCLAVLWILKSTVAAIIFPVMILGLIIVRRLLDFIFSQHDLAWIDNILPEKEKKETDKKRKRKKGAHEDCDEEPQFPPPSVIKIPMESVQSDPQNGIHCIARKRSSSWSYSL

SEQ ID NO: 64610 - protein, 1019 aa, Homo sapiens
MKVKEEKAGVGKLDHTNHRRRFPDQKGSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKPTRPDRGWFVAPFGKNPWWVYPASILPALLVTILIFMDQQITAVIVNRKENKLKKAAGYHLDLFWVGILMALCSFMGLPWYVAATVISIAHIDSLKMETETSAPGEQPQFLGVREQRVTGIIVFILTGISVFLAPILKCIPLPVLYGVFLYMGVASLNGIQFWERCKLFLMPAKHQPDHAFLRHVPLRRIHLFTLVQILCLAVLWILKSTVAAIIFPVMILGLIIVRRLLDFIFSQHDLAWIDNILPEKEKKETDKKRKRKKGAHEDCDEEPQFPPPSVIKIPMESVQSDPQNGIHCIARKRSSSWSYSL

SEQ ID NO: 64611 - protein, 1019 aa, Homo sapiens; identical to SEQ ID NO: 64610

SEQ ID NO: 64612 - protein, 1040 aa, Homo sapiens; identical to SEQ ID NO: 64608

SEQ ID NO: 64613 - protein, 1137 aa, Homo sapiens; identical to SEQ ID NO: 64609

SEQ ID NO: 64614 - protein, 1121 aa, Homo sapiens
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKVRALVADFSIVFSILMFCGIDACFGLETPKLHVPSVIKPTRPDRGWFVAPFGKNPWWVYPASILPALLVTILIFMDQQITAVIVNRKENKLKKAAGYHLDLFWVGILMALCSFMGLPWYVAATVISIAHIDSLKMETETSAPGEQPQFLGVREQRVTGIIVFILTGISVFLAPILKCIPLPVLYGVFLYMGVASLNGIQFWERCKLFLMPAKHQPDHAFLRHVPLRRIHLFTLVQILCLAVLWILKSTVAAIIFPVMILGLIIVRRLLDFIFSQHDLAWIDNILPEKEKKETDKKRKRKKGAHEDCDEEPQFPPPSVIKIPMESVQSDPQNGIHCIARKRSSSWSYSL

SEQ ID NO: 64615 - protein, 993 aa, Homo sapiens
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKVRALVADFSIVFSILMFCGIDACFGLETPKLHVPSVIKPTRPDRGWFVAPFGKNPWWVYPASILPALLVTILIFMDQQITAVIVNRKENKLKGTESNRHHRLHPDGNLCLPGSHPKVYPPAGAVRSLPLHGRGLPEWHPVLGTLQALPDASQAPAGPCLPAARAAAPDPPLHPGADPLPGGALDPQIHGGCHHLPGHDPGPHHRSKASGFHLFPARPGLD

SEQ ID NO: 64616 - protein, 964 aa, Homo sapiens
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKPTRPDRGWFVAPFGKNPWWVYPASILPALLVTILIFMDQQITAVIVNRKENKLKGTESNRHHRLHPDGNLCLPGSHPKVYPPAGAVRSLPLHGRGLPEWHPVLGTLQALPDASQAPAGPCLPAARAAAPDPPLHPGADPLPGGALDPQIHGGCHHLPGHVSLHHRSWASSSFEGFWISSFPSTTWPGLTTS

SEQ ID NO: 64617 - protein, 129 aa, Homo sapiens
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEW

SEQ ID NO: 64618 - protein, 145 aa, Homo sapiens
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEG

SEQ ID NO: 64619 - protein, 1142 aa, Homo sapiens
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKVRALVADFSIVFSILMFCGIDACFGLETPKLHVPSVIKPTRPDRGWFVAPFGKNPWWVYPASILPALLVTILIFMDQQITAVIVNRKENKLKKAAGYHLDLFWVGILMALCSFMGLPWYVAATVISIAHIDSLKMETETSAPGEQPQFLGVREQRVTGIIVFILTGISVFLAPILKCIPLPVLYGVFLYMGVASLNGIQMGTGGSEFKIQKKLTPFWERCKLFLMPAKHQPDHAFLRHVPLRRIHLFTLVQILCLAVLWILKSTVAAIIFPVMSLSTTDLGLIIVRRLLDFIFSQHDLAWIDNILPEKEKKETDKKRKRKKGAHEDCDEEPQFPPPSVIKIPMESVQSDPQNGIHCIARKRSSSWSYSL

SEQ ID NO: 64620 - protein, 1214 aa, Homo sapiens
MERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 64621 - protein, 800 aa, Homo sapiens
MEVVEAEKIVLLTSARFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 64622 - protein, 574 aa, Homo sapiens
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRVQ

SEQ ID NO: 64623 - protein, 1090 aa, Homo sapiens
MERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 64624 - protein, 1135 aa, Homo sapiens
MEADGAGEQMRPLLTRVTSRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 64625 - protein, 1095 aa, Homo sapiens
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 64626 - protein, 463 aa, Homo sapiens
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRVQ

SEQ ID NO: 64627 - protein, 574 aa, Homo sapiens; identical to SEQ ID NO: 64622

SEQ ID NO: 64628 - protein, 1246 aa, Homo sapiens
MEADGAGEQMRPLLTRVTSRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 64629 - protein, 1259 aa, Homo sapiens
MEADGAGEQMRPLLTRVTSRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 64630 - protein, 1131 aa, Homo sapiens
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 64631 - protein, 463 aa, Homo sapiens; identical to SEQ ID NO: 64626

SEQ ID NO: 64632 - protein, 1044 aa, Homo sapiens; identical to SEQ ID NO: 64594

SEQ ID NO: 64633 - protein, 1071 aa, Homo sapiens
MFNKNNSNKLRSTPRYRRGDPGYLNFTELGPLKPEQKDQWSQHRPDEEAVVDQGGTSTILNIHYEKEELEGHRTLYVGVRMPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRVRSMVSDFAVFLTIFTMVIIDFLIGVPSPKLQVPSVFKPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFIPMPVLYGVFLYMGVSSLQGIQFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEVIVLAPTVYLGASNYRT

SEQ ID NO: 64634 - protein, 747 aa, Homo sapiens; identical to SEQ ID NO: 64593

SEQ ID NO: 64635 - protein, 1093 aa, Homo sapiens
MPAAGSNEPDGVLSYQRPDEEAVVDQGGTSTILNIHYEKEELEGHRTLYVGVRMPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRVRSMVSDFAVFLTIFTMVIIDFLIGVPSPKLQVPSVFKPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFIPMPVLYGVFLYMGVSSLQGIQFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEEAEKMLEIGGDKFPLESRKLLSSPGKNISCRCDPSEINISDEMPKTTVWKALSMNSGNAKEKSLFN

SEQ ID NO: 64636 - protein, 638 aa, Homo sapiens
MPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSVSLGAARCPSIVTTGLGGTSK

SEQ ID NO: 64637 - protein, 991 aa, Homo sapiens
MPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRVRSMVSDFAVFLTIFTMVIIDFLIGVPSPKLQVPSVFKPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFIPMPVLYGVFLYMGVSSLQGIQFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEVIVLAPTVYLGASNYRT

SEQ ID NO: 64638 - protein, 1106 aa, Homo sapiens
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSIESRKEKKADSGKGVDRETCL

SEQ ID NO: 64639 - protein, 1099 aa, Homo sapiens
MQSLGVSGNRKVMQSGTCEPFQSLSHQRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSSPS

SEQ ID NO: 64640 - protein, 1117 aa, Homo sapiens
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNGQVVSPQSAPACVENKNDVSRENSTVDFSKGLGGQQKGHTSPCGMKQRHEKGPPHQQEREVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSSPS

SEQ ID NO: 64641 - protein, 1088 aa, Homo sapiens
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSSPS

SEQ ID NO: 64642 - protein, 1054 aa, Homo sapiens
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKGLGGQQKGHTSPCGMKQRHEKGPPHQQEREVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEH

SEQ ID NO: 64643 - protein, 1118 aa, Homo sapiens
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKGLGGQQKGHTSPCGMKQRHEKGPPHQQEREVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSSPS

SEQ ID NO: 64644 - protein, 1105 aa, Homo sapiens
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNGQVVSPQSAPACVENKNDVSRENSTVDFSKVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSIESRKEKKADSGKGVDRETCL

SEQ ID NO: 64645 - protein, 408 aa, Homo sapiens
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKGLGGQQKGHTSPCGMKQRHEKGPPHQQEREVDLHFMKKIPPGAEASNILVGELEFLDRTVVAFVRLSPAVLLQGLAEVPIPTRYFMMLPIKLKIVMTWYQELMSFWIRLLFSLLENGIQAFE

SEQ ID NO: 64646 - protein, 891 aa, Homo sapiens
MSQVGGRGDRCTQEVQGLVHGAGDLSASLAENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 64647 - protein, 918 aa, Homo sapiens
MGVYGPQDRSESEKRDVQRDPPPWHPRREGERPARARSLPLAAAGQGFLRKTWISEHENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 64648 - protein, 316 aa, Homo sapiens
MAAATRRVFHLQPCENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPE

SEQ ID NO: 64649 - protein, 875 aa, Homo sapiens
MAAATRRVFHLQPCENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 64650 - protein, 370 aa, Homo sapiens
MTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 64651 - protein, 513 aa, Homo sapiens
MSSKPEPKDVHQLNGTGPSASPCSSDGPGREPLAGTSEFLGPDGAGVEVVIESRANAKGVREEDALLENGSQSNESDDVSTDRGPAPPSPLKETSFSIGLQVLFPFLLAGFGTVAAGMVLDIVQHWEVFQKVTEVFILVPALLGLKGNLEMTLASRLSTAANIGHMDTPKELWRMITGNMALIQVQATVVGFLASIAAVVFGWIPDGHFSIPHAFLLCASSVATAFIASLVLGMIMIGVIIGSRKIGINPDNVATPIAASLGDLITLALLSGISWGLYLELNHWRYIYPLVCAFFVALLPVWVVLARRSPATREVLYSGWEPVIIAMAISSVGGLILDKTVSDPNFAGMAVFTPVINGVGGNLVAVQASRISTFLHMNGMPGENSEQAPRRCPSPCTTFFSPDVNSRSARVLFLLVVPGHLVFLYTISCMQGGHTTLTLIFIIFYMTAALLQVLILLYIADWMVHWMWGRGLDPDNFSIPYLTALGDLLGTGLLALSFHVLWLIGDRDTDVGD

SEQ ID NO: 64652 - protein, 573 aa, Homo sapiens
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSFHANNGHASSSCSQKYDDYANYNYCDGRETSETTAMLQDEDISSDGDEDAIVEVTPKLPKESSGIMALQILVPFLLAGFGTVSAGMVLDIVQHWEVFRKVTEVFILVPALLGLKGNLEMTLASRLSTAVNIGKMDSPIEKWNLIIGNLALKQVQATVVGFLAAVAAIILGWIPEGKYYLDHSILLCSSSVATAFIASLLQGIIMVGVIVGSKKTGINPDNVATPIAASFGDLITLAILAWISQGLYSCLETYYYISPLVGVFFLALTPIWIIIAAKHPATRTVLHSGWEPVITAMVISSIGGLILDTTVSDPNLVGIVVYTPVINGIGGNLVAIQASRISTYLHLHSIPGELPDEPKGCYYPFRTFFGPGVNNKSAQVLLLLVIPGHLIFLYTIHLMKSGHTSLTIIFIVVYLFGAVLQVFTLLWIADWMVHHFWRKGKDPDSFSIPYLTALGDLLGTALLALSFHFLWLIGDRDGDVGD

SEQ ID NO: 64653 - protein, 122 aa, Homo sapiens
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSFHANNGHASSSCSQKYDDYANYNYCDGRE

SEQ ID NO: 64654 - protein, 143 aa, Homo sapiens
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSFHANNGHASSSCSQKYDDYANYNYCDGRETSETTAMLQDEDISSDGDEDA

SEQ ID NO: 64655 - protein, 46 aa, Homo sapiens
MTNSKGRSITDKTSGGPSSGGGFVDWTLRLNTIQSDKFLNLLLSMV

SEQ ID NO: 64656 - protein, 72 aa, Homo sapiens
MTNSKGRSITDKTSGGPSSGGGFVDWTLRLNTIQSDKFLNLLLSMVPVIYQKNQEDRHKKANGIWQDGLSTA

SEQ ID NO: 64657 - protein, 12 aa, Homo sapiens
MTNSKGRSITDK

SEQ ID NO: 64658 - protein, 76 aa, Homo sapiens
MTNSKGRSITDKTSGGPSSGGGFVDWTLRLNTIQSDKFLNLLLSMVPVIYQKNQEDRHKKANGIWQDGLSTAVQTF

SEQ ID NO: 64659 - protein, 94 aa, Homo sapiens
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSF

SEQ ID NO: 64660 - protein, 507 aa, Homo sapiens
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGSSSVGHTAAVPRRCTASPGWGLIQPFICTQHLIVSLLSFYFPFCLLAKTSI

SEQ ID NO: 64661 - protein, 471 aa, Homo sapiens
MDGTETRQRRLDSCGKPGELGLPHPLSTGGLPVASEDGALRAPESQSVTPKPLETEPSRETTWSIGLQVTVPFMFAGLGLSWAGMLLDYFQANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGSSSVGHTAAVPRRCTASPGWGLIQPFICTQHLIVSLLSFYFPFCLLAKTSI

SEQ ID NO: 64662 - protein, 487 aa, Homo sapiens
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 64663 - protein, 461 aa, Homo sapiens
MVVTQLNLEFCFQGKKLRGFSCELTRSPHGVLPESFFTIMCQVVVPILLSGLCMMTAGLVMNTIQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 64664 - protein, 478 aa, Homo sapiens
MDGTETRQRRLDSCGKPGELGLPHPLSTGGLPVASEDGALRAPESQSVTPKPLETEPSRVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 64665 - protein, 152 aa, Homo sapiens
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAANTGQIDDPQEQHRVISSNLALIQV

SEQ ID NO: 64666 - protein, 152 aa, Homo sapiens; identical to SEQ ID NO: 64665

SEQ ID NO: 64667 - protein, 86 aa, Homo sapiens
MDGTETRQRRLDSCGKPGELGLPHPLSTGGLPVASEDGALRAPESQSVTPKPLETEPSRETTWSIGLQVTVPFMFAGLGLSWAGML

SEQ ID NO: 64668 - protein, 201 aa, Homo sapiens
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGE

SEQ ID NO: 64669 - protein, 137 aa, Homo sapiens
MDGTETRQRRLDSCGKPGELGLPHPLSTGGLPVASEDGALRAPESQSVTPKPLETEPSRETTWSIGLQVTVPFMFAGLGLSWAGMLLDYFQANTGQIDDPQEQHRVISSNLALIQVQATVVGLLAAVAALLLGVVSR

SEQ ID NO: 64670 - protein, 152 aa, Homo sapiens; identical to SEQ ID NO: 64665

SEQ ID NO: 64671 - protein, 559 aa, Homo sapiens
MAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLPNMFGNLRSTLMALMIGSYASSAITFPGIKLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 64672 - protein, 559 aa, Homo sapiens; identical to SEQ ID NO: 64671

SEQ ID NO: 64673 - protein, 110 aa, Homo sapiens
MAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVG

SEQ ID NO: 64674 - protein, 569 aa, Homo sapiens
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGSACFAVSCLLIAYGASKPNALSVLIFIALALNGFGGMCMTFTSLTLPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 64675 - protein, 573 aa, Homo sapiens
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGSACFAVSCLLIAYGASKPNALSVLIFIALALNGFGGMCMTFTSLTLPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTASSTVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 64676 - protein, 432 aa, Homo sapiens
MTYGSPQANASPSDAVALDHGEVSRRQQQELPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 64677 - protein, 446 aa, Homo sapiens
MTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMLKKR

SEQ ID NO: 64678 - protein, 657 aa, Homo sapiens
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMASGASSA

SEQ ID NO: 64679 - protein, 652 aa, Homo sapiens
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMIK

SEQ ID NO: 64680 - protein, 654 aa, Homo sapiens
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMLKKR

SEQ ID NO: 64681 - protein, 657 aa, Homo sapiens; identical to SEQ ID NO: 64678

SEQ ID NO: 64682 - protein, 706 aa, Homo sapiens
MGDERPHYYGKHGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLQDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 64683 - protein, 706 aa, Homo sapiens
MGDERPHYYGKHGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLQDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFCEDLERNDGSQERPYFMSPELRDILLKGSAEEGKR

SEQ ID NO: 64684 - protein, 704 aa, Homo sapiens
MEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLQDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 64685 - protein, 710 aa, Homo sapiens
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNVTPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLMLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 64686 - protein, 668 aa, Homo sapiens
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQTVITSLQQELCPSFLLPSAPALGRCFPWTNVTPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLMLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 64687 - protein, 710 aa, Homo sapiens; identical to SEQ ID NO: 64685

SEQ ID NO: 64688 - protein, 411 aa, Homo sapiens
  MOD_RES (1)..(1): Any amino acid
XRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNVTPPALPGITNDTTIQQGISGLIDSLNARDISVKIFEDFAQSWYWILVAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLR

SEQ ID NO: 64689 - protein, 411 aa, Homo sapiens
  MOD_RES (1)..(1): Any amino acid
XRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNITPPALPGITNDTTIQQGISGLIDSLNARDISVKIFEDFAQSWYWILVAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLR

SEQ ID NO: 64690 - protein, 710 aa, Homo sapiens [sequence omitted]

SEQ ID NO: 64691 - protein, 710 aa, Homo sapiens [sequence omitted]

SEQ ID NO: 64692 - protein, 710 aa, Homo sapiens; identical to SEQ ID NO: 64685

SEQ ID NO: 64693 - protein, 411 aa, Homo sapiens; identical to SEQ ID NO: 64688
  MOD_RES (1)..(1): Any amino acid

SEQ ID NO: 64694 - protein, 411 aa, Homo sapiens; identical to SEQ ID NO: 64688
  MOD_RES (1)..(1): Any amino acid

SEQ ID NO: 64695 - protein, 411 aa, Homo sapiens; identical to SEQ ID NO: 64689
  MOD_RES (1)..(1): Any amino acid

SEQ ID NO: 64696 - protein, 710 aa, Homo sapiens [sequence omitted]

SEQ ID NO: 64697 - protein, 411 aa, Homo sapiens; identical to SEQ ID NO: 64689
  MOD_RES (1)..(1): Any amino acid

SEQ ID NO: 64698 - protein, 710 aa, Homo sapiens; identical to SEQ ID NO: 64685

SEQ ID NO: 64699 - protein, 411 aa, Homo sapiens; identical to SEQ ID NO: 64688
  MOD_RES (1)..(1): Any amino acid

SEQ ID NO: 64700 - protein, 634 aa, Homo sapiens
MGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNVTPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLMLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 64701 - protein, 634 aa, Homo sapiens; identical to SEQ ID NO: 64700

SEQ ID NO: 64702 - protein, 634 aa, Homo sapiens
MGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNITPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLVLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 64703 - protein, 668 aa, Homo sapiens [sequence omitted]

SEQ ID NO: 64704 - protein, 634 aa, Homo sapiens; identical to SEQ ID NO: 64700

SEQ ID NO: 64705 - protein, 634 aa, Homo sapiens; identical to SEQ ID NO: 64700

SEQ ID NO: 64706 - protein, 668 aa, Homo sapiens; identical to SEQ ID NO: 64686

SEQ ID NO: 64707 - protein, 668 aa, Homo sapiens; identical to SEQ ID NO: 64686

SEQ ID NO: 64708 - protein, 668 aa, Homo sapiens [sequence omitted]

SEQ ID NO: 64709 - protein, 634 aa, Homo sapiens; identical to SEQ ID NO: 64702

SEQ ID NO: 64710 - protein, 668 aa, Homo sapiens; identical to SEQ ID NO: 64686

SEQ ID NO: 64711 - protein, 668 aa, Homo sapiens [sequence omitted]

SEQ ID NO: 64712 - protein, 634 aa, Homo sapiens; identical to SEQ ID NO: 64702

SEQ ID NO: 64713 - protein, 748 aa, Homo sapiens
MIPAASSTPPGDALFPSVAPQDFWRSQVTGYSGSVTRHLSHRANNFKRHPKRRKCIRPSPPPPPNTPCPLELVDFGDLHPQRSFRELLFNGCILFGIEFSYAMETAYVTPVLLQMGLPDQLYSLVWFISPILGFLLQPLLGAWSDRCTSRFGRRRPFILVLAIGALLGLSLLLNGRDIGIALADVTGNHKWGLLLTVCGVVLMDFSADSADNPSHAYMMDVCSPADQDRGLNIHALLAGLGGGFGYVVGGIHWDKTGFGRALGGQLRVIYLFTAVTLSVTTVLTLVSIPERPLRPPSEKRAAMKSPSLPLPPSPPVLPEEGPGDSLPSHTATNFSSPISPPSPLTPKYGSFISRDSSLTGISEFASSFGTANIDSVLIDCFTGGHDSYLAIPGSVPRPPISVSFPRAPDGFYRQDRGLLEGREGALTSGCDGDILRVGSLDTSKPRSSGILKRPQTLAIPDAAGGGGPETSRRRNVTFSQQVANILLNGVKYESELTGSSERAEQPLSVGRLCSTICNMPKALRTLCVNHFLGWLSFEGMLLFYTDFMGEVVFQGDPKAPHTSEAYQKYNSGVTMGCWGMCIYAFSAAFYSAILEKLEEFLSVRTLYFIAYLAFGLGTGLATLSRNLYVVLSLCITYGILFSTLCTLPYSLLCDYYQSKKFAGSSADGTRRGMGVDISLLSCQYFLAQILVSLVLGPLTSAVGSANGVMYFSSLVSFLGCLYSSLFVIYEIPPSDAADEEHRPLLLNV

SEQ ID NO: 64714 - protein, 782 aa, Homo sapiens
MLQQPGPRPGRQQPSGDRDACRLHPQGRPPALPTMIPAASSTPPGDALFPSVAPQDFWRSQVTGYSGSVTRHLSHRANNFKRHPKRRKCIRPSPPPPPNTPCPLELVDFGDLHPQRSFRELLFNGCILFGIEFSYAMETAYVTPVLLQMGLPDQLYSLVWFISPILGFLLQPLLGAWSDRCTSRFGRRRPFILVLAIGALLGLSLLLNGRDIGIALADVTGNHKWGLLLTVCGVVLMDFSADSADNPSHAYMMDVCSPADQDRGLNIHALLAGLGGGFGYVVGGIHWDKTGFGRALGGQLRVIYLFTAVTLSVTTVLTLVSIPERPLRPPSEKRAAMKSPSLPLPPSPPVLPEEGPGDSLPSHTATNFSSPISPPSPLTPKYGSFISRDSSLTGISEFASSFGTANIDSVLIDCFTGGHDSYLAIPGSVPRPPISVSFPRAPDGFYRQDRGLLEGREGALTSGCDGDILRVGSLDTSKPRSSGILKRPQTLAIPDAAGGGGPETSRRRNVTFSQQVANILLNGVKYESELTGSSERAEQPLSVGRLCSTICNMPKALRTLCVNHFLGWLSFEGMLLFYTDFMGEVVFQGDPKAPHTSEAYQKYNSGVTMGCWGMCIYAFSAAFYSAILEKLEEFLSVRTLYFIAYLAFGLGTGLATLSRNLYVVLSLCITYGILFSTLCTLPYSLLCDYYQSKKFAGSSADGTRRGMGVDISLLSCQYFLAQILVSLVLGPLTSAVGSANGVMYFSSLVSFLGCLYSSLFVIYEIPPSDAADEEHRPLLLNV

SEQ ID NO: 64715 - protein, 748 aa, Homo sapiens; identical to SEQ ID NO: 64713

SEQ ID NO: 64716 - protein, 530 aa, Homo sapiens
MGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTGFGGALGYLLGAIDWAHLELGRLLGTEFQVMFFFSALVLTLCFTVHLCSISEAPLTEVAKGIPPQQTPQDPPLSSDGMYEYGSIEKVKNGYVNPELAMQGAKNKNHAEQTRRAMTLKSLLRALVNMPPHYRYLCISHLIGWTAFLSNMLFFTDFMGQIVYRGDPYSAHNSTEFLIYERGVEVGCWGLCINSVFSSLYSYFQKVLVSYIGLKGLYFTGYLLFGLGTGFIGLFPNVYSTLVLCSLFGVMSSTLYTVPFNLITEYHREEEKERQQAPGGDPDNSVRGKGMDCATLTCMVQLAQILVGGGLGFLVNTAGTVVVVVITASAVALIGCCFVALFVRYVD

SEQ ID NO: 64717 - protein, 471 aa, Homo sapiens
MGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAGFGGALGYLLGAIDWAHLELGRLLGTEFQVMFFFSALVLTLCFTVHLCSISEAPLTEVAKGIPPQQTPQDPPLSSDGMYEYGSIEKVKNGYVNPELAMQGAKNKNHAEQTRRAMTLKSLLRALVNMPPHYRYLCISHLIGWTAFLSNMLFFTDFMGQIVYRGDPYSAHNSTEFLIYERGVEVGCWGLCINSVFSSLYSYFQKVLVSYIGLKGLYFTGYLLFGLGTGFIGLFPNVYSTLVLCSLFGVMSSTLYTVPFNLITEYHREEEKERQQAPGGDPDNSVRGKGMDCATLTCMVQLAQILVGGGLGFLVNTAGTVVVVVITASAVALIGCCFVALFVRYVD

SEQ ID NO: 64718 - protein, 298 aa, Homo sapiens
MGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTGTRRAMTLKSLLRALVNMPPHYRYLCISHLIGWTAFLSNMLFFTDFMGQIVYRGDPYSAHNSTEFLIYERGVEVGCWGLCINSVFSSLYSCKSFSLLRMSSKSFWSSTTWI

SEQ ID NO: 64719 - protein, 460 aa, Homo sapiens
MGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTGFGGALGYLLGAIDWAHLELGRLLGTEFQVMFFFSALVLTLCFTVHLCSISEAPLTEVAKGIPPQQTPQDPPLSSDGMYEYGSIEKVKNGYVNPELAMQGAKNKNHAEQTRRAMTLKSLLRALVNMPPHYRYLCISHLIGWTAFLSNMLFFTDFMGQIVYRGDPYSAHNSTEFLIYERGVEVGCWGLCINSVFSSLYSYFQKVLVSYIGLKGLYFTGYLLFGLGTGFIGLFPNVYSTLVLCSLFGVMSSTLYTVPFNLITEYHREEEKEVCCH

SEQ ID NO: 64720 - protein, 243 aa, Homo sapiens
MGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTDSQGNDIKVTAESTGEHASSLPLPLHQPPHWMDSLPVQHAVLHRFHGPDCVPRGSL

SEQ ID NO: 64721 - protein, 246 aa, Homo sapiens
MALYLNGATVVAGFGGALGYLLGAIDWAHLELGRLLGTEFQVMFFFSALVLTLCFTVHLCSISEAPLTEVAKGIPPQQTPQDPPLSSDGMYEYGSIEKVKNGYVNPELAMQGAKNKNHAEQTRRAMTLKSLLRALVNMPPHYRYLCISHLIGWTAFLSNMLFFTDFMGQIVYRGDPYSAHNSTEFLIYERGVEVGCWGLCINSVFSSLYSYFQKVLVSYIGLKGLYFTGYLLFGLGTGFIGLFPNV

SEQ ID NO: 64722 - protein, 553 aa, Homo sapiens
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 64723 - protein, 430 aa, Homo sapiens
MEGSASPPEKPRARPAAAVLCRGPVEPLVFLANFALVLQGPLTTQYLWHRFSADLGYNGTRQRGGCSNRSADPTMQEVETLTSHWTLYMNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKLLQYCLADAWVAEIGLAFNILGMVVFAFATITPLMFTGALFSAVACVNSLAMLTASGFNSLYPATLNFMKGFPFLLGAGLLLIPAVLIGMLEKADPHLEFQQFPQSP

SEQ ID NO: 64724 - protein, 459 aa, Homo sapiens
MEGSASPPEKPRARPAAAVLCRGPVEPLVFLANFALVLQGPLTTQYLWHRFSADLGYNGTRQRGGCSNRSADPTMQEVETLTSHWTLYMNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKLLQYCLADAWVAEIGLAFNILGMVVFAFATITPLMFTGYGLLFLSLVITPVIRAKLSKLVRETEQGALFSAVACVNSLAMLTASGIFNSLYPATLNFMKGFPFLLGAGLLLIPAVLIGMLEKADPHLEFQQFPQSP

SEQ ID NO: 64725 - protein, 475 aa, Homo sapiens
MSPEVTCPRRGHLPRFHPRTWVEPVVASSQVAASLYDAGLLLVVKASYGTGGSSNHSASPSPRGALEDQQQRAISNFYIIYNLVVGLSPLLSAYGLGWLSDRYHRKISICMSLLGFLLSRLGLLLKVLLDWPVEVLYGAAALNGLFGGFSAFWSGVMALGSLGSSEGRRSVRLILIDLMLGLAGFCGSMASGHLFKQMAGHSGQGLILTACSVSCASFALLYSLLVLKVPESVAKPSQELPAVDTVSGTVGTYRTLDPDQLDQQYAVGHPPSPGKAKPHKTTIALLFVGAIIYDLAVVGTVDVIPLFVLREPLGWNQVQVGYGMAAGYTIFITSFLGVLVFSRCFRDTTMIMIGMVSFGSGALLLAFVKETYMFYIARAVMLFALIPVTTIRSAMSKLIKGSSYGKVFVILQLSLALTGVVTSTLYNKIYQLTMDMFVGSCFALSSFLSFLAIIPISIVAYKQVPLSPYGDIIEK

SEQ ID NO: 64726 - protein, 570 aa, Homo sapiens
MEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGLWSGIIICTVFQAVCFLGFIIQLNWKKACQQAQVHANLKVNNVPRSGNSALPQDPLHPGCPENLEGILTNDVGKTGEPQSDQQMRQEEPLPEHPQDGAKLSRKQLVLRRGLLLLGVFLILLVGILVRFYVRIQ

SEQ ID NO: 64727 - protein, 586 aa, Homo sapiens
MEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGLWSGIIICTVFQAVCFLGFIIQLNWKKACQQAQVHANLKVNNVPRSGNSALPQDPLHPGCPENLEGILTNDVGKTGEPQSDQQMRQEEPLPEHPQDGAKLSRKQLVLRRGLLLLGVFLILLAGVRWCDHSSLQPRTLGLQAILLCQPPE

SEQ ID NO: 64728 - protein, 282 aa, Homo sapiens
MVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGLWSGIIICTVFQAVCFLGFIIQLNWKKACQQAQVHANLKVNNVPRSGNSALPQDPLHPGCPENLEGILTNDVGKTGEPQSDQQMRQEEPLPEHPQDGAKLSRKQLVLRRGLLLLGVFLILLVGILVRFYVRIQ

SEQ ID NO: 64729 - protein, 443 aa, Homo sapiens
MEAPEEPAPVRGGPEATLEVRGSRCLRLSAFREELRALLVLAGPAFLVQLMVFLISFISSVFCGHLGKLELDAVTLAIATYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGSGTRQFESKQRASEWEFCSPSGSASPRVP

SEQ ID NO: 64730 - protein, 245 aa, Homo sapiens
MLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGCPENLEGILTNDVGKTGEPQSDQQMRQEEPLPEHPQDGAKLSRKQLVLRRGLLLLGVFLILLVGILVRFYVRIQ

SEQ ID NO: 64731 - protein, 586 aa, Homo sapiens; identical to SEQ ID NO: 64727

SEQ ID NO: 64732 - protein, 244 aa, Homo sapiens
MEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQRLCTGKLDFPVHPGSTPLSLHPREKTASSYMGRLVPRVPAGLGLLPPPGHPQHAHAVHGVVGL

SEQ ID NO: 64733 - protein, 602 aa, Homo sapiens
MDSLQDTVALDHGGCCPALSRLVPRGFGTEMWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQGWLKGQEEESPFQTPGLSILHPSHSHLSRASFHLFQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMIPLGLSIGVCVRVGMALGAADTVQAKRSAVSGVLSIVGISLVLGTLISILKNQLGHIFTNDEDVIALVSQVLPVYSVFHVFEAICCVYGGVLRGTGKQAFGAAVNAITYYIIGLPLGILLTFVVRMRIMGLWLGMLACVFLATAAFVAYTARLDWKLAAEEAKKHSGRQQQQRAESTATRPGPEKAVLSSVATGSSPGITLTTYSRSECHVDFFRTPEEAHALSAPTSRLSVKQLVIRRGAALGAASATLMVGLTVRILATRH

SEQ ID NO: 64734 - protein, 580 aa, Homo sapiens
MDSLQDTVALDHGGCCPALSRLVPRGFGTEMWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMRHSHRLAYAAHVTRIPLGLSIGVCVRVGMALGAADTVQAKRSAVSGVLSIVGISLVLGTLISILKNQLGHIFTNDEDVIALVSQVLPVYSVFHVFEAICCVYGGVLRGTGKQAFGAAVNAITYYIIGLPLGILLTFVVRMRIMGLWLGMLACVFLATAAFVAYTARLDWKLAAEEAKKHSGRQQQQRAESTATRPGPEKAVLSSVATGSSPGITLTTYSRSECHVDFFRTPEEAHALSAPTSRLSVKQLVIRRGAALGAASATLMVGLTVRILATRH

SEQ ID NO: 64735 - protein, 363 aa, Homo sapiens
MDSLQDTVALDHGGCCPALSRLVPRGFGTEMWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMIPLGLSIGVCVRVGMALGAADTVQAKRSAVSGVLSIVGISLVLGTLISILKNQLGHIFTN

SEQ ID NO: 64736 - protein, 296 aa, Homo sapiens
MIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMIPLGLSIGVCVRVGMALGAADTVQAKRSAVSGVLSIARSDPW

SEQ ID NO: 64737 - protein, 643 aa, Homo sapiens
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 64738 - protein, 664 aa, Homo sapiens
MDSSTWSPKTTAVTRPVETHELIRNAADISIIVIYFVVVMAVGLWAMFSTNRGTVGGFFLAGRSMVWWPIGASLFASNIGSGHFVGLAGTGAASGIAIGGFEWNALVLVVVLGWLFVPIYIKAGVVTMPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 64739 - protein, 537 aa, Homo sapiens
MPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 64740 - protein, 396 aa, Homo sapiens
MEVKNFAVWDYVVFAALFFISSGIGVFFAIKERKKATSREFLVGGRQMSFGPVGLSLTASFMSAVTVLGTPSEVYRFGASFLVFFIAYLFVILLTSELFLPVFYRSGITSTYEYLQLRFNKPVRYAATVIYIVQTILYTGVVVYAPALALNQVTGFDLWGSVFATGIVCTFYCTLGGLKAVVWTDAFQMVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLSTVASSINALATVTFEDFVKSCFPHLSDKLSTWISKGLCRYSWWTFYSIS

SEQ ID NO: 64741 - protein, 618 aa, Homo sapiens
MEVKNFAVWDYVVFAALFFISSGIGVFFAIKERKKATSREFLVGGRQMSFGPVGLSLTASFMSAVTVLGTPSEVYRFGASFLVFFIAYLFVILLTSELFLPVFYRSGITSTYEYLQLRFNKPVRYAATVIYIVQTILYTGVVVYAPALALNQVTGFDLWGSVFATGIVCTFYCTLGGLKAVVWTDAFQMVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLSTVASSINALATVTFEDFVKSCFPHLSDKLSTWISKGLCLLFGVMCTSMAVAASVMGGVVQASLSIHGMCGGPMLGLFSLGIVFPFVNWKGALGGLLTGITLSFWVAIGAFIYPAPASKTWPLPLSTDQCIKSNVTATGPPVLSSRPGIADTWYSISYLYYSAVGCLGCIVAGVIISLITGRQRGEDIQPLLIRPVCNLFCFWSKKYKTLCWCGVQHDSGTEQENLENGSARKQGAESVLQNGLRRESLVHVPGYDPKDKSYNNMAFETTHF

SEQ ID NO: 64742 - protein, 277 aa, Homo sapiens
MVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLSTVASSINALATVTFEDFVKSCFPHLSDKLSTWISKGLCRSLIWRDVYLYGCGCICHGRCCAGFPQHSRHVWRTNAGLILPGNRVPFCELEGCTRRSSYWNHLVILGGHWGLHLPCTSL

SEQ ID NO: 64743 - protein, 672 aa, Homo sapiens
MEEHTEAGSAPEMGAQKALIDNPADILVIAAYFLLVIGVGLWSMCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGLRGLMLAVMLAALMSSLASIFNSSSTLFTMDIYTRLRPRAGDRELLLVGRLWVVFIVVVSVAWLPVVQAAQGGQLFDYIQAVSSYLAPPVSAVFVLALFVPRVNEQGAFWGLIGGLLMGLARLIPEFSFGSGSCVQPSACPAFLCGVHYLYFAIVLFFCSGLLTLTVSLCTAPIPRKHLHRLVFSLRHSKEEREDLDADEQQGSSLPVQNGCPESAMEMNEPQAPAPSLFRQCLLWFCGMSRGGVGSPPPLTQEEAAAAARRLEDISEDPSWARVVNLNALLMMAVAVFLWGFYA

SEQ ID NO: 64744 - protein, 458 aa, Homo sapiens
MEEHTEAGSAPEMGAQKALIDNPADILVIAAYFLLVIGVGLWSMCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGRLLGTHRGPADGPGTPDSRVLLRLGQLCAALGVPSFPLRRALPLLRHCAVLLLWPPHPHGLPVHRAHPQKAPPPPGLQSPA

SEQ ID NO: 64745 - protein, 718 aa, Homo sapiens
MRAVLDTADIAIVALYFILVMCIGFFAMWKSNRSTVSGYFLAGRSMTWVTIGASLFVSNIGSEHFIGLAGSGAASGFAVGAWEFNALLLLQLLGWVFIPIYIRSGVYTMPEYLSKRFGGHRIQVYFAALSLILYIFTKLSVDLYSGALFIQESLGWNLYVSVILLIGMTALLTVTGGLVAVIYTDTLQALLMIIGALTLMIISIMEIGGFEEVKRRYMLASPDVTSILLTYNLSNTNSCNVSPKKEALKMLRNPTDEDVPWPGFILGQTPASVWYWCADQVIVQRVLAAKNIAHAKGSTLMAGFLKLLPMFIIVVPGMISRILFTDDIACINPEHCMLVCGSRAGCSNIAYPRLVMKLVPVGLRGLMMAVMIAALMSDLDSIFNSASTIFTLDVYKLIRKSASSRELMIVGRIFVAFMVVISIAWVPIIVEMQGGQMYLYIQEVADYLTPPVAALFLLAIFWKRCNEQGAFYGGMAGFVLGAVRLILAFAYRAPECDQPDNRPGFIKDIHYMYVATGLFWVTGLITVIVSLLTPPPTKEQIRTTTFWSKKNLVVKENCSPKEEPYQMQEKSILRCSENNETINHIIPNGKSEDSIKGLQPEDVNLLVTCREEGNPVASLGHSEAETPVDAYSNGQAALMGEKERKKETDDGGRYWKFIDWFCGFKSKSLSKRSLRDLMEEEAVCLQMLEETRQVKVILNIGLFAVCSLGIFMFVYFSL

SEQ ID NO: 64746 - protein, 167 aa, Homo sapiens
MEAGGFLDSLIYGACVVFTLGMFSAGLSDLRHMRMTRSVDNVQFLPFLTTEVNNLGWLSYGALKGDGILIVVNTVGAALQTLYILAYLHYCPRKAKVIQTKSTQCLSYPLTIATLLTSASWCLYGFRLRDPYIMVSNFPGIVTSFIRFWLFWKYPQEQDRNYWLLQT

SEQ ID NO: 64747 - protein, 166 aa, Homo sapiens
MRGLHPWHVLRRPLGPQAHANDPECGQRPVPALSHHGSQRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 64748 - protein, 221 aa, Homo sapiens
MEAGGFLDSLIYGACVVFTLGMFSAGLSDLRHMRMTRSVDNVQFLPFLTTEVNNLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 64749 - protein, 156 aa, Homo sapiens
MEELGPQAHANDPECGQRPVPALSHHGSQRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 64750 - protein, 642 aa, Homo sapiens
MDKLKCPSFFKCREKEKVSASSENFHVGENDENQDRGNWSKKSDYLLSMIGYAVGLGNVWRFPYLTYSNGGGAFLIPYAIMLALAGLPLFFLECSLGQFASLGPVSVWRILPLFQGVGITMVLISIFVTIYYNVIIAYSLYYMFASFQSELPWKNCSSWSDKNCSRSPIVTHCNVSTVNKGIQEIIQMNKSWVDINNFTCINGSEIYQPGQLPSEQYWNKVALQRSSGMNETGVIVWYLALCLLLAWLIVGAALFKGIKSSGKVVYFTALFPYVVLLILLVRGATLEGASKGISYYIGAQSNFTKLKEAEVWKDAATQIFYSLSVAWGGLVALSSYNKFKNNCFSDAIVVCLTNCLTSVFAGFAIFSILGHMAHISGKEVSQVVKSGFDLAFIAYPEALAQLPGGPFWSILFFFMLLTLGLDSQFASIETITTTIQDLFPKVMKKMRVPITLGCCLVLFLLGLVCVTQAGIYWVHLIDHFCAGWGILIAAILELVGIIWIYGGNRFIEDTEMMIGAKRWIFWLWWRACWFVITPILLIAIFIWSLVQFHRPNYGAIPYPDWGVALGWCMIVFCIIWIPIMAIIKIIQAKGNIFQRLISCCRPASNWGPYLEQHRGERYKDMVDPKKEADHEIPTVSGSRKPE

SEQ ID NO: 64751 - protein, 512 aa, Homo sapiens
MGVQWWSHTQGEVAVGLGLGDSYLTPCPCPGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 64752 - protein, 614 aa, Homo sapiens
MDGKVAVQECGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFSSFTSELPWTTCNNFWNTEHCTDFLNHSGAGTVTPFENFTSPVMEFWERRVLGITSGIHDLGSLRWELALCLLLAWVICYFCIWKGVKSTGKVVYFTATFPYLMLVILLIRGVTLPGAYQGIIYYLKPDLFRLKDPQVWMDAGTQIFFSFAICQGCLTALGSYNKYHNNCYKDCIALCFLNSATSFVAGFVVFSILGFMSQEQGVPISEVAESGPGLAFIAFPKAVTMMPLSQLWSCLFFIMLIFLGLDSQFVCVECLVTASIDMFPRQLRKSGRRELLILTIAVMCYLIGLFLVTEGGMYIFQLFDYYASSGICLLFLSLFEVVCISWVYGADRFYDNIEDMIGYRPWPLVKISWLFLTPGLCLATFLFSLSKYTPLKYNNVYVYPPWGYSIGWFLALSSMVCVPLFVVITLLKTRGPFRKRLRQLITPDSSLPQPKQHPCLDGSAGRNFGPSPTREGLIAGEKETHL

SEQ ID NO: 64753 - protein, 614 aa, Homo sapiens; identical to SEQ ID NO: 64752

SEQ ID NO: 64754 - protein, 614 aa, Homo sapiens; identical to SEQ ID NO: 64752

SEQ ID NO: 64755 - protein, 614 aa, Homo sapiens; identical to SEQ ID NO: 64752

SEQ ID NO: 64756 - protein, 614 aa, Homo sapiens; identical to SEQ ID NO: 64752

SEQ ID NO: 64757 - protein, 146 aa, Homo sapiens
MDGKVAVQECGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFS

SEQ ID NO: 64758 - protein, 635 aa, Homo sapiens
MAKKSAENGIYSVSGDEKKGPLIAPGPDGAPAKGDGPVGLGTPGGRLAVPPRETWTRQMDFIMSCVGFAVGLGNVWRFPYLCYKNGGGVFLIPYVLIALVGGIPIFFLEISLGQFMKAGSINVWNICPLFKGLGYASMVIVFYCNTYYIMVLAWGFYYLVKSFTTTLPWATCGHTWNTPDCVEIFRHEDCANASLANLTCDQLADRRSPVIEFWENKVLRLSGGLEVPGALNWEVTLCLLACWVLVYFCVWKGVKSTGKIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 64759 - protein, 729 aa, Homo sapiens
MLPTLQIQGPAAFAPGDRGPGRHCPFPVPITPTGALLPVSDSCDSLVDLVWPSVTYLALGTQSRVWPHPLGAPGQAGESPEQRRQCLELWDMASSLGDKVPRAACGKRGQTVWQLHLACLCLAQFHSPPAQPPPLSRRGGGPDPDPISRSLPGPPTPALPTHSYSSHSPRAPRLLSPLRRAPRGSPAPHRHASLQTNEAPRELPHCTWPGLPGRSLAPSFLWREPWLGGQWGPLNIPARKGDRRRWEWGCEGGGATASAEQPGPQIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQVCMGLWDREPGGGRREGCRQGKGWRRCGARPELPWPQFVGVEGFITGLLDLLPASYYFRFQREISVALCCALCFVIDLSMVTDVSGVGGLPVTSGGRLPSSLTGLCPQGGMYVFQLFDYYSASGTTLLWQAFWECVVVAWVYGRSWLRAGLGDGGGEGRSPAWPASPRGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 64760 - protein, 156 aa, Homo sapiens
LLHSPTWSWSCCWCVECCCLAPWMASFTISSLTGQSWGPLSPGQLQPLQQQLLQWDQLLCWLRGLLHPGLHGCRAGRAHLQGGRVREISVALCCALCFVIDLSMVTDGGMYVFQLFDYYSASGTTLLWQAFWECVVVAWVYGADRFMDDIACMIGY

SEQ ID NO: 64761 - protein, 112 aa, Homo sapiens
  MOD_RES (1)..(1): Any amino acid
XFRHEDCANASLANLTCDQLADRRSPVIEFWENKVLRLSGGLEVPGALNWEVTLCLLACWVLVYFCVWKGVKSTGKVPLEACSGEGGSALGAGCLCQAHLWQREVTRQSLAL

SEQ ID NO: 64762 - protein, 520 aa, Homo sapiens
MKAGSINVWNICPLFKGLGYASMVIVFYCNTYYIMVLAWGFYYLVKSFTTTLPWATCGHTWNTPDCVEIFRHEDCANASLANLTCDQLADRRSPVIEFWENKVLRLSGGLEVPGALNWEVTLCLLACWVLVYFCVWKGVKSTGKIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 64763 - protein, 174 aa, Homo sapiens
  MOD_RES (1)..(1): Any amino acid
XIDAGTQIFFSYAIGLGALTALGSYNRFNNNCYNGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFW

SEQ ID NO: 64764 - protein, 89 aa, Homo sapiens [sequence omitted]

SEQ ID NO: 64765 - protein, 620 aa, Homo sapiens
MSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 64766 - protein, 620 aa, Homo sapiens; identical to SEQ ID NO: 64765

SEQ ID NO: 64767 - protein, 599 aa, Homo sapiens [sequence omitted]

SEQ ID NO: 64768 - protein, 39 aa, Homo sapiens
MATNGSKVADGQISTEVSEAPVANDKPKTLVVKVQKKAA

SEQ ID NO: 64769 - protein, 421 aa, Homo sapiens
MVNTTNMTSAVVEFWERNMHQMTDGLDKPGQIRWPLAITLAIAWILVYFCIWKGVGWTGKVVYFSATYPYIMLIILFFRGVTLPGAKEGILFYITPNFRKLSDSEVWLDAATQIFFSYGLGLGSLIALGSYNSFHNNVYRDSIIVCCINSCTSMFAGFVIFSIVGFMAHVTKRSIADVAASGPGLAFLAYPEAVTQLPISPLWAILFFSMLLMLGIDSQFCTVEGFITALVDEYPRLLRNRRELFIAAVCIISYLIGLSNITQGGIYVFKLFDYYSASGMSLLFLVFFECVSISWFYGVNRFYDNIQEMVGSRPCIWWKLCWSFFTPIIVAGVFIFSAVQMTPLTMGNYVFPKWGQGVGWLMALSSMVLIPGYMAYMFLTLKGSLKQRIQVMVQPSEDIVRPENGPEQPQAGSSTSKEAYI

SEQ ID NO: 64770 - protein, 632 aa, Homo sapiens
MTAEKALPLGNGKAAEEARESEAPGGGCSSGGAAPARHPRVKRDKAVHERGHWNNKVEFVLSVAGEIIGLGNVWRFPYLCYKNGGGAFLIPYVVFFICCGIPVFFLETALGQFTSEGGITCWRKVCPLFEGIGYATQVIEAHLNVYYIIILAWAIFYLSNCFTTELPWATCGHEWNTENCVEFQKLNVSNYSHVSLQNATSPVMEFWEHRVLAISDGIEHIGNLRWELALCLLAAWTICYFCIWKGTKSTGKVVYVTATFPYIMLLILLIRGVTLPGASEGIKFYLYPDLSRLSDPQVWVDAGTQIFFSYAICLGCLTALGSYNNYNNNCYRDCIMLCCLNSGTSFVAGFAIFSVLGFMAYEQGVPIAEVAESGPGLAFIAYPKAVTMMPLSPLWATLFFMMLIFLGLDSQFVCVESLVTAVVDMYPKVFRRGYRRELLILALSVISYFLGLVMLTEGGMYIFQLFDSYAASGMCLLFVAIFECICIGWVYGSNRFYDNIEDMIGYRPPSLIKWCWMIMTPGICAGIFIFFLIKYKPLKYNNIYTYPAWGYGIGWLMALSSMLCIPLWICITVWKTEGTLPEKLQKLTTPSTDLKMRGKLGVSPRMVTVNDCDAKLKSDGTIAAITEKETHF

SEQ ID NO: 64771 - protein, 208 aa, Homo sapiens
MTAEKALPLGNGKAAEEARESEAPGGGCSSGGAAPARHPRVKRDKAVHERGHWNNKVEFVLSVAGEIIGLGNVWRFPYLCYKNGGGAFLIPYVVFFICCGIPVFFLETALGQFTSEGGITCWRKVCPLFEGIGYATQVIEAHLNVYYIIILAWAIFYLSNCFTTELPWATCGHEWNTENCVEFQKLNVSNYSHVSLQNATSPVMEFWE

SEQ ID NO: 64772 - protein, 797 aa, Homo sapiens
MDCSAPKEMNKLPANSPEAAAAQGHPDGPCAPRTSPEQELPAAAAPPPPRVPRSASTGAQTFQSADARACEAERPGVGSCKLSSPRAQAASAALRDLREAQGAQASPPPGSSGPGNALHCKIPFLRGPEGDANVSVGKGTLERNNTPVVGWVNMSQSTVVLATDGITSVLPGSVATVATQEDEQGDENKARGNWSSKLDFILSMVGYAVGLGNVWRFPYLAFQNGGGAFLIPYLMMLALAGLPIFFLEVSLGQFASQGPVSVWKAIPALQGCGIAMLIISVLIAIYYNVIICYTLFYLFASFVSVLPWGSCNNPWNTPECKDKTKLLLDSCVISDHPKIQIKNSTFCMTAYPNVTMVNFTSQANKTFVSGSEEYFKYFVLKISAGIEYPGEIRWPLALCLFLAWVIVYASLAKGIKTSGKVVYFTATFPYVVLVILLIRGVTLPGAGAGIWYFITPKWEKLTDATVWKDAATQIFFSLSAAWGGLITLSSYNKFHNNCYRDTLIVTCTNSATSIFAGFVIFSVIGFMANERKVNIENVADQGPGIAFVVYPEALTRLPLSPFWAIIFFLMLLTLGLDTMFATIETIVTSISDEFPKYLRTHKPVFTLGCCICFFIMGFPMITQGGIYMFQLVDTYAASYALVIIAIFELVGISYVYGLQRFCEDIEMMIGFQPNIFWKVCWAFVTPTILTFILCFSFYQWEPMTYGSYRYPNWSMVLGWLMLACSVIWIPIMFVIKMHLAPGRFIERLKLVCSPQPDWGPFLAQHRGERYKNMIDPLGTSSLGLKLPVKDLELGTQC

SEQ ID NO: 64773 - protein, 652 aa, Homo sapiens
MSGGDTRAAIARPRMAAAHGPVAPSSPEQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 64774 - protein, 706 aa, Homo sapiens
MSGGDTRAAIARPRMAAAHGPVAPSSPEQVTLLPVQRSFFLPPFSGATPSTSLAESVLKVWHGAYNSGLLPQLMAQHSLAMAQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 64775 - protein, 574 aa, Homo sapiens
MFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFLQAQVHRRLPQNPLHFASLPERNVLLHQLPQRGGVPEHDPPTPPSPARTYGPQVRVREVPRARRQRSPNPAPLWAPPSPKPHPCSAAGPLGWDCPFRNCQSLALSSARLLADSDAGGPETRQWEPGP

SEQ ID NO: 64776 - protein, 633 aa, Homo sapiens
MVGKGAKGMLNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 64777 - protein, 522 aa, Homo sapiens
MMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 64778 - protein, 134 aa, Homo sapiens
MSGGDTRAAIARPRMAAAHGPVAPSSPEQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVV

SEQ ID NO: 64779 - protein, 386 aa, Homo sapiens
MFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQASIGCC

SEQ ID NO: 64780 - protein, 636 aa, Homo sapiens
MKKLQGAHLRKPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALMVYSIVKYQPSEYGSYRFPPWAELLGILMGLLSCLMIPAGMLVAVLREEGSLWERLQQASRPAMDWGPSLEENRTGMYVATLAGSQSPKPLMVHMRKYGGITSFENTAIEVDREIAEEEESMM

SEQ ID NO: 64781 - protein, 628 aa, Homo sapiens
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQMKTRQGRRRATNSCQISC

SEQ ID NO: 64782 - protein, 617 aa, Homo sapiens [sequence omitted]

SEQ ID NO: 64783 - protein, 617 aa, Homo sapiens [sequence omitted]

SEQ ID NO: 64784 - protein, 331 aa, Homo sapiens
MVVVIVLYFSLWKGVKTSGKVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 64785 - protein, 630 aa, Homo sapiens
METTPLNSQKQLSACEDGEDCQENGVLQKVVPTPGDKVESGQISNGYSAVPSPGAGDDTRHSIPATTTTLVAELHQGERETWGKKVDFLLSVIGYAVDLGNVWRFPYICYQNGGGAFLLPYTIMAIFGGIPLFYMELALGQYHRNGCISIWRKICPIFKGIGYAICIIAFYIASYYNTIMAWALYYLISSFTDQLPWTSCKNSWNTGNCTNYFSEDNITWTLHSTSPAEEFYTRHVLQIHRSKGLQDLGGISWQLALCIMLIFTVIYFSIWKGVKTSGKVVWVTATFPYIILSVLLVRGATLPGAWRGVLFYLKPNWQKLLETGVWIDAAAQIFFSLGPGFGVLLAFASYNKFNNNCYQDALVTSVVNCMTSFVSGFVIFTVLGYMAEMRNEDVSEVAKDAGPSLLFITYAEAIANMPASTFFAIIFFLMLITLGLDSTFAGLEGVITAVLDEFPHVWAKRRERFVLAVVITCFFGSLVTLTFGGAYVVKLLEEYATGPAVLTVALIEAVAVSWFYGITQFCRDVKEMLGFSPGWFWRICWVAISPLFLLFIICSFLMSPPQLRLFQYNYPYWSIILGYCIGTSSFICIPTYIAYRLIITPGTFKERIIKSITPETPTEIPCGDIRLNAV

SEQ ID NO: 64786 - protein, 672 aa, Homo sapiens
MSQSRRVNPDDRELGGDPQIQAPRDQLGSLADGHQCHLLTSRMETTPLNSQKQLSACEDGEDCQENGVLQKVVPTPGDKVESGQISNGYSAVPSPGAGDDTRHSIPATTTTLVAELHQGERETWGKKVDFLLSVIGYAVDLGNVWRFPYICYQNGGGAFLLPYTIMAIFGGIPLFYMELALGQYHRNGCISIWRKICPIFKGIGYAICIIAFYIASYYNTIMAWALYYLISSFTDQLPWTSCKNSWNTGNCTNYFSEDNITWTLHSTSPAEEFYTRHVLQIHRSKGLQDLGGISWQLALCIMLIFTVIYFSIWKGVKTSGKVVWVTATFPYIILSVLLVRGATLPGAWRGVLFYLKPNWQKLLETGVWIDAAAQIFFSLGPGFGVLLAFASYNKFNNNCYQDALVTSVVNCMTSFVSGFVIFTVLGYMAEMRNEDVSEVAKDAGPSLLFITYAEAIANMPASTFFAIIFFLMLITLGLDSTFAGLEGVITAVLDEFPHVWAKRRERFVLAVVITCFFGSLVTLTFGGAYVVKLLEEYATGPAVLTVALIEAVAVSWFYGITQFCRDVKEMLGFSPGWFWRICWVAISPLFLLFIICSFLMSPPQLRLFQYNYPYWSIILGYCIGTSSFICIPTYIAYRLIITPGTFKERIIKSITPETPTEIPCGDIRLNAV

SEQ ID NO: 64787 - protein, 630 aa, Homo sapiens; identical to SEQ ID NO: 64785

SEQ ID NO: 64788 - protein, 620 aa, Homo sapiens
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWERNVLSLSPGIDHPGSLKWDLALCLLLVWLVCFFCIWKGVRSTGKVVYFTATFPFAMLLVLLVRGLTLPGAGAGIKFYLYPDITRLEDPQVWIDAGTQIFFSYAICLGAMTSLGSYNKYKYNSYRDCMLLGCLNSGTSFVSGFAIFSILGFMAQEQGVDIADVAESGPGLAFIAYPKAVTMMPLPTFWSILFFIMLLLLGLDSQFVEVEGQITSLVDLYPSFLRKGYRREIFIAFVCSISYLLGLTMVTEGGMYVFQLFDYYAASGVCLLWVAFFECFVIAWIYGGDNLYDGIEDMIGYRPGPWMKYSWAVITPVLCVGCFIFSLVKYVPLTYNKTYVYPNWAIGLGWSLALSSMLCVPLVIVIRLCQTEGPFLVRVKYLLTPREPNRWAVEREGATPYNSRTVMNGALVKPTHIIVETMM

SEQ ID NO: 64789 - protein, 200 aa, Homo sapiens
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWE

SEQ ID NO: 64790 - protein, 359 aa, Homo sapiens
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWERNVLSLSPGIDHPGSLKWDLALCLLLVWLVCFFCIWKGVRSTGKVVYFTATFPFAMLLVLLVRGLTLPGAGAGIKFYLYPDITRLEDPQVWIDAGTQIFFSYAICLGAMTSLGSYNKYKYNSYRSWPGLHCLPKSCDNDAAAHILVHSFFYYASLAWTG

SEQ ID NO: 64791 - protein, 109 aa, Homo sapiens
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGG

SEQ ID NO: 64792 - protein, 620 aa, Homo sapiens; identical to SEQ ID NO: 64788

SEQ ID NO: 64793 - protein, 359 aa, Homo sapiens; identical to SEQ ID NO: 64790

SEQ ID NO: 64794 - protein, 634 aa, Homo sapiens
MVRLVLPNPGLDARIPSLAELETIEQEEASSRPKWDNKAQYMLTCLGFCVGLGNVWRFPYLCQSHGGGAFMIPFLILLVLEGIPLLYLEFAIGQRLRRGSLGVWSSIHPALKGLGLASMLTSFMVGLYYNTIISWIMWYLFNSFQEPLPWSDCPLNENQTGYVDECARSSPVDYFWYRETLNISTSISDSGSIQWWMLLCLACAWSVLYMCTIRGIETTGKAVYITSTLPYVVLTIFLIRGLTLKGATNGIVFLFTPNVTELAQPDTWLDAGAQVFFSFSLAFGGLISFSSYNSVHNNCEKDSVIVSIINGFTSVYVAIVVYSVIGFRATQRYDDCFSTNILTLINGFDLPEGNVTQENFVDMQQRCNASDPAAYAQLVFQTCDINAFLSEAVEGTGLAFIVFTEAITKMPLSPLWSVLFFIMLFCLGLSSMFGNMEGVVVPLQDLRVIPPKWPKEVLTGLICLGTFLIGFIFTLNSGQYWLSLLDSYAGSIPLLIIAFCEMFSVVYVYGVDRFNKDIEFMIGHKPNIFWQVTWRVVSPLLMLIIFLFFFVVEVSQELTYSIWDPGYEEFPKSQKISYPNWVYVVVVIVAGVPSLTIPGYAIYKLIRNHCQKPGDHQGLVSTLSTASMNGDLKY

SEQ ID NO: 64795 - protein, 555 aa, Homo sapiens
MEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 64796 - protein, 592 aa, Homo sapiens
MEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKVVYFTASLPYCVLIIYLIRGLTLHGATNGLMYMFTPKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 64797 - protein, 547 aa, Homo sapiens
MEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKVVYFTASLPYCVLIIYLIRGLTLHGATNGLMYMFTPKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQDDKL

SEQ ID NO: 64798 - protein, 397 aa, Homo sapiens
MAHAPEPDPAACDLGDERPKWDNKAQYLLSCTGFAVGLGNIWRFPYLCQTYGGGAFLIPYVIALVFEGIPIFHVELAIGQRLRKGSVGVWTAISPYLSGVGLGCVTLSFLISLYYNTIVAWVLWYLLNSFQHPLPWSSCPPDLNRTGFVEECQGSSAVSYFWYRQTLNITADINDSGSIQWWLLICLAASWAVVYMCVIRGIETTGKVIYFTALFPYLVLTIFLIRGLTLPGATKGLIYLFTPNNPRVWLDAATQIFFSLSLAFGGHIAFASYNSPRNDCQKDAVVIALVNRMTSLYASIAVFSVLGASGPGLAFVVFTETDLHMPGAPVWAMLFFGMLFTLGLSTMFGTVEAVITPLLDSGNYWLEIFDNFAASPNLLMLAFLEVVGVVYVYGMKR

SEQ ID NO: 64799 - protein, 628 aa, Homo sapiens
MAHAPEPDPAACDLGDERPKWDNKAQYLLSCTGFAVGLGNIWRFPYLCQTYGGGAFLIPYVIALVFEGIPIFHVELAIGQRLRKGSVGVWTAISPYLSGVGLGCVTLSFLISLYYNTIVAWVLWYLLNSFQHPLPWSSCPPDLNRTGFVEECQGSSAVSYFWYRQTLNITADINDSGSIQWWLLICLAASWAVVYMCVIRGIETTGKVIYFTALFPYLVLTIFLIRGLTLPGATKGLIYLFTPNMHILQNPRVWLDAATQIFFSLSLAFGGHIAFASYNSPRNDCQKDAVVIALVNRMTSLYASIAVFSVLGFKATNDYEHCLDRNILSLINDFDFPEQSISRDDYPAVLMHLNATWPKRVAQLPLKACLLEDFLDKSASGPGLAFVVFTETDLHMPGAPVWAMLFFGMLFTLGLSTMFGTVEAVITPLLDVGVLPRWVPKEALTGLVCLVCFLSATCFTLQSGNYWLEIFDNFAASPNLLMLAFLEVVGVVYVYGMKRFCDDIAWMTGRRPSPYWRLTWRVVSPLLLTIFVAYIILLFWKPLRYKAWNPKYELFPSRQEKLYPGWARAACVLLSLLPVLWVPVAALAQLLTRRRRTWRDRDARPDTDMRPDTDTRPDTDMRPDTDMR

SEQ ID NO: 64800 - protein, 515 aa, Homo sapiens
MEAREPGRPTPTYHLVPNTSQSQVEEDVSSPPQRSSETMQLKKEISLLNGVSLVVGNMIGSGIFVSPKGVLVHTASYGMSLIVWAIGGLFSVVGALCYAELGTTITKSGASYAYILEAFGGFIAFIRLWVSLLVVEPTGQAIIAITFANYIIQPSFPSCDPPYLACRLLAAACICLLTFVNCAYVKWGTRVQDTFTYAKVVALIAIIVMGLVKLCQGHSEHFQDAFEGSSWDMGNLSLALYSALFSYSGWDTLNFVTEEIKNPERNLPLAIGISMPIVTLIYILTNVAYYTVLNISDVLSSDAVAVTFADQTFGMFSWTIPIAVALSCFGGLNASIFASSRLFFVGSREGHLPDLLSMIHIERFTPIPALLFNCTMALIYLIVEDVFQLINYFSFSYWFFVGLSVVGQLYLRWKEPKRPRPLKLSVFFPIVFCICSVFLVIVPLFTDTINSLIGIGIALSGVPFYFMGVYLPESRRPLFIRNVLAAITRGTQQLCFCVLTELDVAEEKKDERKTD

SEQ ID NO: 64801 - protein, 507 aa, Homo sapiens
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 64802 - protein, 303 aa, Homo sapiens
MGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVEGLRDRGG

SEQ ID NO: 64803 - protein, 535 aa, Homo sapiens
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 64804 - protein, 210 aa, Homo sapiens
MGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLHLLSAVLRWSPRGPPSQCVGHDPREALHPNPSPALHMHLHPADAGHQRHVHTHQLCGLHQLPLLWGHGCWTDSPSLEEA

SEQ ID NO: 64805 - protein, 230 aa, Homo sapiens
  MOD_RES (1)..(1): Any amino acid
XCLQEHSQPSQLLCTLLLCWCVLGRERPFRKAQSTSSPLEGVPRFLKRLLLTWVNCSSVRWATRVQDIFTAGKLLALALIIIMGIVQICKGEYFWLEPKNAFENFQEPDIGLVALAFLQGSFAYGGWNFLNYVTEELVDPYKLFFAGAREGHLPSVLAMIHVKRCTPIPALLFTCISTLLMLVTSDMYTLINYVGFINYLFYGVTVAGQIVLRWKKPDIPRPIKPLPYQG

SEQ ID NO: 64806 - protein, 311 aa, Homo sapiens
MGQLFQCAVGHPGSRHLHSWEAPGLGPDYHHGDCTDMQRNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 64807 - protein, 332 aa, Homo sapiens
MGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 64808 - protein, 94 aa, Homo sapiens
MEEGARHRNNTEKKHPGGGESDASPEAGSGGGGVALKKEIGLVSACGIIVGNIIGSGIFVSPKGVLENAGSVGLALIVWIVTGFITVVGALCYA

SEQ ID NO: 64809 - protein, 78 aa, Homo sapiens
MEEGARHRNNTEKKHPGGGESDASPEAGSGGGGVALKKEIGLVSACGIIVGNIIGSGIFVSPKGVLENAGSVGLALIV

SEQ ID NO: 64810 - protein, 430 aa, Homo sapiens
MGQYGQELSWKCLVKAVCLQEHSQPSQLLCTLLLCWCVLGRERPFRKAQSTSSPLEGVPRFLKRLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 64811 - protein, 515 aa, Homo sapiens; identical to SEQ ID NO: 64800

SEQ ID NO: 64812 - protein, 229 aa, Homo sapiens
MEAREPGRPTPTYHLVPNTSQSQVEEDVSSPPQRSSETMQLKKEISLLNGVSLVVGNMIGSGIFVSPKGVLVHTASYGMSLIVWAIGGLFSVVGALCYAELGTTITKSGASYAYILEAFGGFIAFIRLWVSLLVVEPTGQAIIAITFANYIIQPSFPSCDPPYLACRLLAAACICLLTFVNCAYVKWGTRVQDTFTYAKVVALIAIIVMGLVKLCQEICPWPLGFLCQL

SEQ ID NO: 64813 - protein, 511 aa, Homo sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAACICLLTFINCAYVKWGTLVQDIFTYAKVLALIAVIVAGIVRLGQGASTHFENSFEGSSFAVGDIALALYSALFSYSGWDTLNYVTEEIKNPERNLPLSIGISMPIVTIIYILTNVAYYTVLDMRDILASDAVAVTFADQIFGIFNWIIPLSVALSCFGGLNASIVAASRLFFVGSREGHLPDAICMIHVERFTPVPSLLFNGIMALIYLCVEDIFQLINYYSFSYWFFVGLSIVGQLYLRWKEPDRPRPLKLSVFFPIVFCLCTIFLVAVPLYSDTINSLIGIAIALSGLPFYFLIIRVPEHKRPLYLRRIVGSATRYLQVLCMSVAAEMDLEDGGEMPKQRDPKSN

SEQ ID NO: 64814 - protein, 511 aa, Homo sapiens; identical to SEQ ID NO: 64813

SEQ ID NO: 64815 - protein, 511 aa, Homo sapiens; identical to SEQ ID NO: 64813

SEQ ID NO: 64816 - protein, 511 aa, Homo sapiens; identical to SEQ ID NO: 64813

SEQ ID NO: 64817 - protein, 484 aa, Homo sapiens
MVDSTEYEVASQPEVETSPLGDGASPGPEQVKLKKEIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAACICLLTFINCAYVKWGTLVQDIFTYAKVLALIAVIVAGIVRLGQGASTHFENSFEGSSFAVGDIALALYSALFSYSGWDTLNYVTEEIKNPERNLPLSIGISMPIVTIIYILTNVAYYTVLDMRDILASDAVAVTFADQIFGIFNWIIPLSVALSCFGGLNASIVAASRLFFVGSREGHLPDAICMIHVERFTPVPSLLFNGIMALIYLCVEDIFQLINYYSFSYWFFVGLSIVGQLYLRWKEPDRPRPLKLSVFFPIVFCLCTIFLVAVPLYSDTINSLIGIAIALSGLPFYFLIIRVPEHKRPLYLRRIVGSATRYLQVLCMSVAAEMDLEDGGEMPKQRDPKSN

SEQ ID NO: 64818 - protein, 141 aa, Homo sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFAN

SEQ ID NO: 64819 - protein, 44 aa, Homo sapiens
MVDSTEYEVASQPEVETSPLGDGASPGPEQVKLKKEISLLNGVC

SEQ ID NO: 64820 - protein, 164 aa, Homo sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAA

SEQ ID NO: 64821 - protein, 122 aa, Homo sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWT

SEQ ID NO: 64822 - protein, 511 aa, Homo sapiens; identical to SEQ ID NO: 64813

SEQ ID NO: 64823 - protein, 115 aa, Homo sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFL

SEQ ID NO: 64824 - protein, 30 aa, Homo sapiens
MVDSTEYEVASQPEVETSPLGDGASPGPEQ

SEQ ID NO: 64825 - protein, 310 aa, Homo sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAACICLLTFINCAYVKWGTLVQDIFTYAKVLALIAVIVAGIVRLGQGASTHFENSFEGSSFAVGDIALALYSALFSYSGWDTLNYVTEEIKNPERNLPLSIGISMPIVTIIYILTNVAYYTVLDMRDILASDAVAVAFLCGLKRRPSP

SEQ ID NO: 64826 - protein, 106 aa, Homo sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAY

SEQ ID NO: 64827 - protein, 116 aa, Homo sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLA

SEQ ID NO: 64828 - protein, 629 aa, Homo sapiens
MGCKVLLNIGQQMLRRKVVDCSREETRLSRCLNTFDLVALGVGSTLGAGVYVLAGAVARENAGPAIVISFLIAALASVLAGLCYGEFGARVPKTGSAYLYSYVTVGELWAFITGWNLILSYIIGTSSVARAWSATFDELIGRPIGEFSRTHMTLNAPGVLAENPDIFAVIIILILTGLLTLGVKESAMVNKIFTCINVLVLGFIMVSGFVKGSVKNWQLTEEDFGNTSGRLCLNNDTKEGKPGVGGFMPFGFSGVLSGAATCFYAFVGFDCIATTGEEVKNPQKAIPVGIVASLLICFIAYFGVSAALTLMMPYFCLDNNSPLPDAFKHVGWEGAKYAVAVGSLCALSASLLGSMFPMPRVIYAMAEDGLLFKFLANVNDRTKTPIIATLASGAVAAVMAFLFDLKDLVDLMSIGTLLAYSLVAACVLVLRYQPEQPNLVYQMASTSDELDPADQNELASTNDSQLGFLPEAEMFSLKTILSPKNMEPSKISGLIVNISTSLIAVLIITFCIVTVLGREALTKGALWAVFLLAGSALLCAVVTGVIWRQPESKTKLSFKVPFLPVLPILSIFVNVYLMMQLDQGTWVRFAVWMLIGFIIYFGYGLWHSEEASLDADQARTPDGNLDQCK

SEQ ID NO: 64829 - protein, 121 aa, Homo sapiens
MGCKVLLNIGQQMLRRKVVDCSREETRLSRCLNTFDLVALGVGSTLGAGVYVLAGAVARENAGPAIVISFLIAALASVLAGLCYGEFGARVPKTGSAYLYSYVTVGELWAFITGWNLILSY

SEQ ID NO: 64830 - protein, 698 aa, Homo sapiens
MKIETSGYNSDKLICRGFIGTPAPPVCDSKFLLSPSSDVRMIPCRAALTFARCLIRRKIVTLDSLEDTKLCRCLSTMDLIALGVGSTLGAGVYVLAGEVAKADSGPSIVVSFLIAALASVMAGLCYAEFGARVPKTGSAYLYTYVTVGELWAFITGWNLILSYVIGTSSVARAWSGTFDELLSKQIGQFLRTYFRMNYTGLAEYPDFFAVCLILLLAGLLSFGVKESAWVNKVFTAVNILVLLFVMVAGFVKGNVANWKISEEFLKNISASAREPPSENGTSIYGAGGFMPYGFTGTLAGAATCFYAFVGFDCIATTGEEVRNPQKAIPIGIVTSLLVCFMAYFGVSAALTLMMPYYLLDEKSPLPVAFEYVGWGPAKYVVAAGSLCALSTSLLGSIFPMPRVIYAMAEDGLLFKCLAQINSKTKTPIIATLSSGAVAALMAFLFDLKALVDMMSIGTLMAYSLVAACVLILRYQPGLSYDQPKCSPEKDGLGSSPRVTSKSESQVTMLQRQGFSMRTLFCPSLLPTQQSASLVSFLVGFLAFLVLGLSVLTTYGVHAITRLEAWSLALLALFLVLFVAIVLTIWRQPQNQQKVAFMVPFLPFLPAFSILVNIYLMVQLSADTWVRFSIWMAIGFLIYFSYGIRHSLEGHLRDENNEEDAYPDNVHAAAEEKSAIQANDHHPRNLSSPFIFHEKTSEF

SEQ ID NO: 64831 - protein, 697 aa, Homo sapiens
MKIETSGYNSDKLICRGFIGTPAPPVCDSKFLLSPSSDVRMIPCRAALTFARCLIRRKIVTLDSLEDTKLCRCLSTMDLIALGVGSTLGAGVYVLAGEVAKADSGPSIVVSFLIAALASVMAGLCYAEFGARVPKTGSAYLYTYVTVGELWAFITGWNLILSYVIGTSSVARAWSGTFDELLSKQIGQFLRTYFRMNYTGLAEYPDFFAVCLILLLAGLLSFGVKESAWVNKVFTAVNILVLLFVMVAGFVKGNVANWKISEEFLKNISASAREPPSENGTSIYGAGGFMPYGFTGTLAGAATCFYAFVGFDCIATTGEEVRNPQKAIPIGIVTSLLVCFMAYFGVSAALTLMMPYYLLDEKSPLPVAFEYVGWGPAKYVVAAGSLCALSTSLLGSMFPLPRILFAMARDGLLFRFLARVSKRQSPVAATLTAGVISALMAFLFDLKALVDMMSIGTLMAYSLVAACVLILRYQPGLSYDQPKCSPEKDGLGSSPRVTSKSESQVTMLQRQGFSMRTLFCPSLLPTQQSASLVSFLVGFLAFLVLGLSVLTTYGVHAITRLEAWSLALLALFLVLFVAIVLTIWRQPQNQQKVAFMVPFLPFLPAFSILVNIYLMVQLSADTWVRFSIWMAIGFLIYFSYGIRHSLEGHLRDENNEEDAYPDNVHAAAEEKSAIQANDHHPRNLSSPFIFHEKTSEF

SEQ ID NO: 64832 - protein, 697 aa, Homo sapiens; identical to SEQ ID NO: 64831

SEQ ID NO: 64833 - protein, 658 aa, Homo sapiens
MIPCRAALTFARCLIRRKIVTLDSLEDTKLCRCLSTMDLIALGVGSTLGAGVYVLAGEVAKADSGPSIVVSFLIAALASVMAGLCYAEFGARVPKTGSAYLYTYVTVGELWAFITGWNLILSYVIGTSSVARAWSGTFDELLSKQIGQFLRTYFRMNYTGLAEYPDFFAVCLILLLAGLLSFGVKESAWVNKVFTAVNILVLLFVMVAGFVKGNVANWKISEEFLKNISASAREPPSENGTSIYGAGGFMPYGFTGTLAGAATCFYAFVGFDCIATTGEEVRNPQKAIPIGIVTSLLVCFMAYFGVSAALTLMMPYYLLDEKSPLPVAFEYVGWGPAKYVVAAGSLCALSTSLLGSIFPMPRVIYAMAEDGLLFKCLAQINSKTKTPIIATLSSGAVAALMAFLFDLKALVDMMSIGTLMAYSLVAACVLILRYQPGLSYDQPKCSPEKDGLGSSPRVTSKSESQVTMLQRQGFSMRTLFCPSLLPTQQSASLVSFLVGFLAFLVLGLSVLTTYGVHAITRLEAWSLALLALFLVLFVAIVLTIWRQPQNQQKVAFMVPFLPFLPAFSILVNIYLMVQLSADTWVRFSIWMAIGFLIYFSYGIRHSLEGHLRDENNEEDAYPDNVHAAAEEKSAIQANDHHPRNLSSPFIFHEKTSEF

SEQ ID NO: 64834 - protein, 658 aa, Homo sapiens; identical to SEQ ID NO: 64833

SEQ ID NO: 64835 - protein, 487 aa, Homo sapiens
MGDTGLRKRREDEKSIQSQEPKTTSLQKELGLISGISIIVGTIIGSGIFVSPKSVLSNTEAVGPCLIIWAACGVLATLGALCFAELGTMITKSGGEYPYLMEAYGPIPAYLFSWASLIVIKPTSFAIICLSFSEYVCAPFYVGCKPPQIVVKCLAAAAILFISTVNSLSVRLGSYVQNIFTAAKLVIVAIIIISGLVLLAQGNTKNFDNSFEGAQLSVGAISLAFYNGLWAYDGWNQLNYITEELRNPYRNLPLAIIIGIPLVTACYILMNVSYFTVMTATELLQSQAVAVTFGDRVLYPASWIVPLFVAFSTIGAANGTCFTAGRLIYVAGREGHMLKVLSYISVRRLTPAPAIIFYGIIATIYIIPGDINSLVNYFSFAAWLFYGLTILGLIVMRFTRKELERPIKVPVVIPVLMTLISVFLVLAPIISKPTWEYLYCVLFILSGLLFYFLFVHYKFGWAQKISKPITMHLQMLMEVVPPEEDPE

SEQ ID NO: 64836 - protein, 487 aa, Homo sapiens; identical to SEQ ID NO: 64835

SEQ ID NO: 64837 - protein, 635 aa, Homo sapiens
MARGLPTIASLARLCQKLNRLKPLEDSTMETSLRRCLSTLDLTLLGVGGMVGSGLYVLTGAVAKEVAGPAVLLSFGVAAVASLLAALCYAEFGARVPRTGSAYLFTYVSMGELWAFLIGWNVLLEYIIGGAAVARAWSGYLDSMFSHSIRNFTETHVGSWQVPLLGHYPDFLAAGIILLASAFVSCGARVSSWLNHTFSAISLLVILFIVILGFILAQPHNWSADEGGFAPFGFSGVMAGTASCFYAFVGFDVIAASSEEAQNPRRSVPLAIAISLAIAAGAYILVSTVLTLMVPWHSLDPDSALADAFYQRGYRWAGFIVAAGSICAMNTVLLSLLFSLPRIVYAMAADGLFFQVFAHVHPRTQVPVAGTLAFGLLTAFLALLLDLESLVQFLSLGTLLAYTFVATSIIVLRFQKSSPPSSPGPASPGPLTKQQSSFSDHLQLVGTVHASVPEPGELKPALRPYLGFLDGYSPGAVVTWALGVMLASAITIGCVLVFGNSTLHLPHWGYILLLLLTSVMFLLSLLVLGAHQQQYREDLFQIPMVPLIPALSIVLNICLMLKLSYLTWVRFSIWLLMGLAVYFGYGIRHSKENQRELPGLNSTHYVVFPRGSLEETVQAMQPPSQAPAQDPGHME

SEQ ID NO: 64838 - protein, 635 aa, Homo sapiens; identical to SEQ ID NO: 64837

SEQ ID NO: 64839 - protein, 82 aa, Homo sapiens
MARGLPTIASLARLCQKLNRLKPLEDSTMETSLRRCLSTLDLTLLGVGGMVGSGLYVLTGAVAKEVAGPAVLLSFGVAAVAS

SEQ ID NO: 64840 - protein, 973 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKALLLNELGGFTITGKYLFGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 64841 - protein, 973 aa, Homo sapiens; identical to SEQ ID NO: 64840

SEQ ID NO: 64842 - protein, 937 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKGGFTITDEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 64843 - protein, 973 aa, Homo sapiens; identical to SEQ ID NO: 64840

SEQ ID NO: 64844 - protein, 937 aa, Homo sapiens; identical to SEQ ID NO: 64842

SEQ ID NO: 64845 - protein, 968 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKALLLNELGGFTITGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 64846 - protein, 937 aa, Homo sapiens; identical to SEQ ID NO: 64842

SEQ ID NO: 64847 - protein, 937 aa, Homo sapiens; identical to SEQ ID NO: 64842

SEQ ID NO: 64848 - protein, 664 aa, Homo sapiens
MRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKGRSLPLEYLTVRNMRKSAVSPLCLRNQNG

SEQ ID NO: 64849 - protein, 965 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKGGFTITGKYLFGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 64850 - protein, 73 aa, Homo sapiens
MYNMRRLSLSPTFSMGFHLLVTVSLLFSHVDHVIAETEMEGEGNETGECTGSYYCKKGVILPIWEPQDPSFGD

SEQ ID NO: 64851 - protein, 87 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVY

SEQ ID NO: 64852 - protein, 87 aa, Homo sapiens; identical to SEQ ID NO: 64851

SEQ ID NO: 64853 - protein, 960 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKEGFWLSSQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 64854 - protein, 937 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKEGFCFTDEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 64855 - protein, 138 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLT

SEQ ID NO: 64856 - protein, 968 aa, Homo sapiens; identical to SEQ ID NO: 64845

SEQ ID NO: 64857 - protein, 921 aa, Homo sapiens
MAPLALVGVTLLLAAPPCSGAATPTPSLPPPPANDSDTSTGGCQGSYRCQPGVLLPVWEPDDPSLGDKAARAVVYFVAMVYMFLGVSIIADRFMAAIEVITSKEKEITITKANGETSVGTVRIWNETVSNLTLMALGSSAPEILLSVIEVCGHNFQAGELGPGTIVGSAAFNMFVVIAVCIYVIPAGESRKIKHLRVFFVTASWSIFAYVWLYLILAVFSPGVVQVWEALLTLVFFPVCVVFAWMADKRLLFYKYVYKRYRTDPRSGIIIGAEGDPPKSIELDGTFVGAEAPGELGGLGPGPAEARELDASRREVIQILKDLKQKHPDKDLEQLVGIANYYALLHQQKSRAFYRIQATRLMTGAGNVLRRHAADASRRAAPAEGAGEDEDDGASRIFFEPSLYHCLENCGSVLLSVTCQGGEGNSTFYVDYRTEDGSAKAGSDYEYSEGTLVFKPGETQKELRIGIIDDDIFEEDEHFFVRLLNLRVGDAQGMFEPDGGGRPKGRLVAPLLATVTILDDDHAGIFSFQDRLLHVSECMGTVDVRVVRSSGARGTVRLPYRTVDGTARGGGVHYEDACGELEFGDDETMKTLQVKIVDDEEYEKKDNFFIELGQPQWLKRGISALLLNQGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPDTFASKVAALQDQCADASIGNVTGSNAVNVFLGLGVAWSVAAVYWAVQGRPFEVRTGTLAFSVTLFTVFAFVGIAVLLYRRRPHIGGELGGPRGPKLATTALFLGLWLLYILFASLEAYCHIRGF

SEQ ID NO: 64858 - protein, 825 aa, Homo sapiens
MFVVIAVCIYVIPAGESRKIKHLRVFFVTASWSIFAYVWLYLILAVFSPGVVQVWEALLTLVFFPVCVVFAWMADKRLLFYKYVYKRYRTDPRSGIIIGAEGDPPKSIELDGTFVGAEAPGELGGLGPGPAEARELDASRREVIQILKDLKQKHPDKDLEQLVGIANYYALLHQQKSRAFYRIQATRLMTGAGNVLRRHAADASRRAAPAEGAGEDEDDGASRIFFEPSLYHCLENCGSVLLSVTCQGGEGNSTFYVDYRTEDGSAKAGSDYEYSEGTLVFKPGETQKELRIGIIDDDIFEEDEHFFVRLLNLRVGDAQGMFEPDGGGRPKGRLVAPLLATVTILDDDHAGIFSFQDRLLHVSECMGTVDVRVVRSSGARGTVRLPYRTVDGTARGGGVHYEDACGELEFGDDETMKTLQVKIVDDEEYEKKDNFFIELGQPQWLKRGISALLLNQGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPGNTLGDFGGVGSQMSQAGATQDPAKMRHVRQQGGGAAGPVRRRVHRQRDRLQRGERVPWPGRRLVCGRRVLGGAGPPLRGAHWHAGLLRHALHRLRLRGHCRAAVPAPAAHRRRAGRPARTQARHHRALPGPLAPVHPLRQPGGVLPHPGLLGPRAETRPHRPPGARDSAAPALGPWSPFPPRLGLLSWDSASLLRPLPWL

SEQ ID NO: 64859 - protein, 384 aa, Homo sapiens
MGTVDVRVVRSSGARGTVRLPYRTVDGTARGGGVHYEDACGELEFGDDETMKTLQVKIVDDEEYEKKDNFFIELGQPQWLKRGISALLLNQGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPDTFASKVAALQDQCADASIGNVTGSNAVNVFLGLGVAWSVAAVYWAVQGRPFEVRTGTLAFSVTLFTVFAFVGIAVLLYRRRPHIGGELGGPRGPKLATTALFLGLWLLYILFASLEAYCHIRGF

SEQ ID NO: 64860 - protein, 677 aa, Homo sapiens
MADKRLLFYKYVYKRYRTDPRSGIIIGAEGDPPKSIELDGTFVGAEAPGELGGLGPGPAEARELDASRREVIQILKDLKQKHPDKDLEQLVGIANYYALLHQQKSRAFYRIQATRLMTGAGNVLRRHAADASRRAAPAEGAGEDEDDGASRIFFEPSLYHCLENCGSVLLSVTCQGGEGNSTFYVDYRTEDGSAKAGSDYEYSEGTLVFKPGETQKELRIGIIDDDIFEEDEHFFVRLLNLRVGDAQGMFEPDGGGRPKGRLVAPLLATVTILDDDHAGIFSFQDRLLHVSECMGTVDVRVVRSSGARGTVRLPYRTVDGTARGGGVHYEDACGELEFGDDETMKTLQVKIVDDEEYEKKDNFFIELGQPQWLKRGISALLLNQGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPDTFASKVAALQDQCADASIGNVTGSNAVNVFLGLGVAWSVAAVYWAVQGRPFEVRTGTLAFSVTLFTVFAFVGIAVLLYRRRPHIGGELGGPRGPKLATTALFLGLWLLYILFASLEAYCHIRGF

SEQ ID NO: 64861 - protein, 815 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLSDPGPHPEPGEGEPFFPKGQ

SEQ ID NO: 64862 - protein, 135 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFPCDPHYLKHRPGELPA

SEQ ID NO: 64863 - protein, 555 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQVLGQGRAGPCLGDPHRLFPWKERKACDLKCDSSPSSTTNLLCDLGRATPPFWASVSSIVK

SEQ ID NO: 64864 - protein, 319 aa, Homo sapiens [sequence omitted]

SEQ ID NO: 64865 - protein, 224 aa, Homo sapiens
MEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLSDPGPHPE

SEQ ID NO: 64866 - protein, 476 aa, Homo sapiens
MAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLSDPGPHPEPGEGEPFFPKGQ

SEQ ID NO: 64867 - protein, 812 aa, Homo sapiens
MEPLGNWRSLRAPLPPMLLLLLLQVAGPVGALAETLLNAPRAMGTSSSPPSPASVVAPGTTLFEESRLPVFTLDYPHVQIPFEITLWILLASLAKIGFHLYHKLPTIVPESCLLIMVGLLLGGIIFGVDEKSPPAMKTDVFFLYLLPPIVLDAGYFMPTRPFFENIGTIFWYAVVGTLWNSIGIGVSLFGICQIEAFGLSDITLLQNLLFGSLISAVDPVAVLAVFENIHVNEQLYILVFGESLLNDAVTVVLYNLFKSFCQMKTIETIDVFAGIANFFVVGIGGVLIGIFLGFIAAFTTRFTHNIRVIEPLFVFLYSYLSYITAEMFHLSGIMAITACAMTMNKYVEENVSQKSYTTIKYFMKMLSSVSETLIFIFMGVSTVGKNHEWNWAFVCFTLAFCLMWRALGVFVLTQVINRFRTIPLTFKDQFIIAYGGLRGAICFALVFLLPAAVFPRKKLFITAAIVVIFFTVFILGITIRPLVEFLDVKRSNKKQQAVSEEIYCRLFDHVKTGIEDVCGHWGHNFWRDKFKKFDDKYLRKLLIRENQPKSSIVSLYKKLEIKHAIEMAETGMISTVPTFASLNDCREEKIRKVTSSETDEIRELLSRNLYQIRQRTLSYNRHSLTADTSERQAKEILIRRRHSLRESIRKDSSLNREHRASTSTSRYLSLPKNTKLPEKLQKRRTISIADGNSSDSDADAGTTVLNLQPRARRFLPEQFSKKSPQSYKMEWKNEVDVDSGRDMPSTPPTPHSREKGTQTSGLLQQPLLSKDQSGSEREDSLTEGIPPKPPPRLVWRASEPGSRKARFGSEKP

SEQ ID NO: 64868 - protein, 834 aa, Homo sapiens
MWGLGARGPDRGLLLALALGGLARAGGVEVEPGGAHGESGGFQVVTFEWAHVQDPYVIALWILVASLAKIGFHLSHKVTSVVPESALLIVLGLVLGGIVWAADHIASFTLTPTVFFFYLLPPIVLDAGYFMPNRLFFGNLGTILLYAVVGTVWNAATTGLSLYGVFLSGLMGDLQIGLLDFLLFGSLMAAVDPVAVLAVFEEVHVNEVLFIIVFGESLLNDAVTVVLYNVFESFVALGGDNVTGVDCVKGIVSFFVVSLGGTLVGVVFAFLLSLVTRFTKHVRIIEPGFVFIISYLSYLTSEMLSLSAILAITFCGICCQKYVKANISEQSATTVRYTMKMLASSAETIIFMFLGISAVNPFIWTWNTAFVLLTLVFISVYRAIGVVLQTWLLNRYRMVQLEPIDQVVLSYGGLRGAVAFALVVLLDGDKVKEKNLFVSTTIIVVFFTVIFQGLTIKPLVQWLKVKRSEHREPRLNEKLHGRAFDHILSAIEDISGQIGHNYLRDKWSHFDRKFLSRVLMRRSAQKSRDRILNVFHELNLKDAISYVAEGERRGSLAFIRSPSTDNVVNVDFTPRSSTVEASVSYLLRENVSAVCLDMQSLEQRRRSIRDAEDMVTHHTLQQYLYKPRQEYKHLYSRHELTPTEDEKQDREIFHRTMRKRLESFKSTKLGLNQNKKAAKLYKRERAQKRRNSSIPNGKLPMESPAQNFTIKEKDLELSDTEEPPNYDEEMSGGIEFLASVTKDTASDSPAGIDNPVFSPDEALDRSLLARLPPWLSPGETVVPSQRARTQIPYSPGTFCRLMPFRLSSKSVDSFLQADGPEERPPAALPESTHM

SEQ ID NO: 64869 - protein, 358 aa, Homo sapiens
MSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVNGVCMEGKQHGDVVSAIRAGGDETKLLVVDRETDEFFKKCRVIPSQEHLNGPLPVPFTNGEIQKENSREALAEAALESPRPALVRSASSDTSEELNSQDSPPKQDSTAPSSTSSSDPILDFNISLAMAKERAHQKRSSKRAPQMDWSKKNELFSNL

SEQ ID NO: 64870 - protein, 273 aa, Homo sapiens
MSADAAAGAPLPRLCCLEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVNGVCMEGKQHGDVVSAIRAGGDGSGGGNQRGAEFPRQPPKTGLHSALVYLLLRPHPRLQHLPGHGQREGPPETQQQTGPADGLEQEKRTLQQPLSALLPPSDWQGRASIPPHLFPSPQLLP

SEQ ID NO: 64871 - protein, 337 aa, Homo sapiens
MAAPEPLRPRLCRLVRGEQGYGFHLHGEKGRRGQFIRRVEPGSPAEAAALRAGDRLVEVNGVNVEGETHHQVVQRIKAVEGQTRLLVVDQETDEELRRRQLTCTEEMAQRGLPPAHDPWEPKPDWAHTGSHSSEAGKKDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEDGSAWKQDPFQESGLHLSPTAAEAKEKARAMRVNKRAPQMDWNRKREIFSNF

SEQ ID NO: 64872 - protein, 326 aa, Homo sapiens
MAAPEPLRPRLCRLVRGEQGYGFHLHGEKGRRGQFIRRVEPGSPAEAAALRAGDRLVEVNGVNVEGETHHQVVQRIKAVEGQTRLLVVDQETDEELRRRQLTCTEEMAQRGLPPAHDPWEPKPDWAHTGSHSSEAGKKDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEESGLHLSPTAAEAKEKARAMRVNKRAPQMDWNRKREIFSNF

SEQ ID NO: 64873 - protein, 798 aa, Homo sapiens
MALQMFVTYSPWNCLLLLVALECSEASSDLNESANSTAQYASNAWFAAASSEPEEGISVFELDYDYVQIPYEVTLWILLASLAKIGFHLYHRLPGLMPESCLLILVGALVGGIIFGTDHKSPPVMDSSIYFLYLLPPIVLEGGYFMPTRPFFENIGSILWWAVLGALINALGIGLSLYLICQVKAFGLGDVNLLQNLLFGSLISAVDPVAVLAVFEEARVNEQLYMMIFGEALLNDGITVVLYNMLIAFTKMHKFEDIETVDILAGCARFIVVGLGGVLFGIVFGFISAFITRFTQNISAIEPLIVFMFSYLSYLAAETLYLSGILAITACAVTMKKYVEENVSQTSYTTIKYFMKMLSSVSETLIFIFMGVSTVGKNHEWNWAFICFTLAFCQIWRAISVFALFYISNQFRTFPFSIKDQCIIFYSGVRGAGSFSLAFLLPLSLFPRKKMFVTATLVVIYFTVFIQGITVGPLVRYLDVKKTNKKESINEELHIRLMDHLKAGIEDVCGHWSHYQVRDKFKKFDHRYLRKILIRKNLPKSSIVSLYKKLEMKQAIEMVETGILSSTAFSIPHQAQRIQGIKRLSPEDVESIRDILTSNMYQVRQRTLSYNKYNLKPQTSEKQAKEILIRRQNTLRESMRKGHSLPWGKPAGTKNIRYLSYPYGNPQSAGRDTRAAGFSDDDSSDPGSPSITFSACSRIGSLQKQEAQEIIPMKSLHRGRKAFSFGYQRNTSQEEYLGGVRRVALRPKPLFHAVDEEGESGGESEGKASLVEVRSRWTADHGHGRDHHRSHSPLLQKK

SEQ ID NO: 64874 - protein, 896 aa, Homo sapiens
MLRAALSLLALPLAGAAEEPTQKPESPGEPPPGLELFRWQWHEVEAPYLVALWILVASLAKIVFHLSRKVTSLVPESCLLILLGLVLGGIVLAVAKKAEYQLEPGTFFLFLLPPIVLDSGYFMPSRLFFDNLGAILTYAVVGTLWNAFTTGAALWGLQQAGLVAPRVQAGLLDFLLFGSLISAVDPVAVLAVFEEVHVNETLFIIVFGESLLNDAVTVVLYKVCNSFVEMGSANVQATDYLKGVASLFVVSLGGAAVGLVFAFLLALTTRFTKRVRIIEPLLVFLLAYAAYLTAEMASLSAILAVTMCGLGCKKYVEANISHKSRTTVKYTMKTLASCAETVIFMLLGISAVDSSKWAWDSGLVLGTLIFILFFRALGVVLQTWVLNQFRLVPLDKIDQVVMSYGGLRGAVAFALVILLDRTKVPAKDYFVATTIVVVFFTVIVQGLTIKPLVKWLKVKRSEHHKPTLNQELHEHTFDHILAAVEDVVGHHGYHYWRDRWEQFDKKYLSQLLMRRSAYRIRDQIWDVYYRLNIRDAISFVDQGGHVLSSTGLTLPSMPSRNSVAETSVTNLLRESGSGACLDLQVIDTVRSGRDREDAVMHHLLCGGLYKPRRRYKASCSRHFISEDAQERQDKEVFQQNMKRRLESFKSTKHNICFTKSKPRPRKTGRRKKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGRSRSESSADLPQQQELQPLMGHKDHTHLSPGTATSHWCIQFNRGSRL

SEQ ID NO: 64875 - protein, 435 aa, Homo sapiens
MRRSAYRIRDQIWDVYYRLNIRDAISFVDQGGHVLSSTGLTLPSMPSRNSVAETSVTNLLRESGSGACLDLQVIDTVRSGRDREDAVMHHLLCGGLYKPRRRIELRTEPCGMLLKTFLQTDMDQAFLGTKPAAVATSSQRMRRSGRTRRSSSRMKRRLESFKSTKHNICFTKSKPRPRKTGRRKKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGLAVRAALTSPSSRSCSPSWATRTTPISAQAPLPPTGASSSTEAAGCSSRPRGGAGGGIPVGSAPWVMGRALET

SEQ ID NO: 64876 - protein, 701 aa, Homo sapiens
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 64877 - protein, 669 aa, Homo sapiens
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 64878 - protein, 649 aa, Homo sapiens
MDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 64879 - protein, 725 aa, Homo sapiens
MEPGDAARPGSGRATGAPPPRLLLLPLLLGWGLRVAAAASASSSGAAAEDSSAMEELATEKEAEESHRQDSVSLLTFILLLTLTILTIWLFKHRRVRFLHETGLAMIYGLIVGVILRYGTPATSGRDKSLSCTQEDRAFSTLLVNVSGKFFEYTLKGEISPGKINSVEQNDMLRKVTFDPEVFFNILLPPIIFHAGYSLKKRHFFRNLGSILAYAFLGTAVSCFIIGNLMYGVVKLMKIMGQLSDKFYYTDCLFFGAIISATDPVTVLAIFNELHADVDLYALLFGESVLNDAVAIVLSSSIVAYQPAGLNTHAFDAAAFFKSVGIFLGIFSGSFTMGAVTGVNANVTKFTKLHCFPLLETALFFLMSWSTFLLAEACGFTGVVAVLFCGITQAHYTYNNLSVESRSRTKQLFEVLHFLAENFIFSYMGLALFTFQKHVFSPIFIIGAFVAIFLGRAAHIYPLSFFLNLGRRHKIGWNFQHMMMFSGLRGAMAFALAIRDTASYARQMMFTTTLLIVFFTVWIIGGGTTPMLSWLNIRVGVEEPSEEDQNEHHWQYFRVGVDPDQDPPPNNDSFQVLQGDGPDSARGNRTKQESAWIFRLWYSFDHNYLKPILTHSGPPLTTTLPAWCGLLARCLTSPQVYDNQEPLREEDSDFILTEGDLTLTYGDSTVTANGSSSSHTASTSLEGSRRTKSSSEEVLERDLGMGDQKVSSRGTRLVFPLEDNA

SEQ ID NO: 64880 - protein, 581 aa, Homo sapiens
MGEKMAEEERFPNTTHEGFNVTLHTTLVVTTKLVLPTPGKPILPVQTGEQAQQEEQSSGMTIFFSLLVLAICIILVHLLIRYRLHFLPESVAVVSLGILMGAVIKIIEFKKLANWKEEEMFRPNMFFLLLLPPIIFESGYSLHKGNFFQNIGSITLFAVFGTAISAFVVGGGIYFLGQADVISKLNMTDSFAFGSLISAVDPVATIAIFNALHVDPVLNMLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 64881 - protein, 597 aa, Homo sapiens
MGEKMAEEERFPNTTHEGFNVTLHTTLVVTTKLVLPTPGKPILPVQTGEQAQQEEQSSGMTIFFSLLVLAICIILVHLLIRYRLHFLPESVAVVSLGILMGAVIKIIEFKKLANWKEEEMFRPNMFFLLLLPPIIFESGYSLHKGNFFQNIGSITLFAVFGTAISAFVVGGGIYFLGQGFFFVCVCVFVCFILQADVISKLNMTDSFAFGSLISAVDPVATIAIFNALHVDPVLNMLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 64882 - protein, 362 aa, Homo sapiens
MLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 64883 - protein, 281 aa, Homo sapiens
MMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 64884 - protein, 645 aa, Homo sapiens
MERQSRVMSEKDEYQFQHQGAVELLVFNFLLILTILTIWLFKNHRFRFLHETGGAMVYGLIMGLILRYATAPTDIESGTVYDCVKLTFSPSTLLVNITDQVYEYKYKREISQHNINPHQGNAILEKMTFDPEIFFNVLLPPIIFHAGYSLKKRHFFQNLGSILTYAFLGTAISCIVIGLIMYGFVKAMIHAGQLKNGDFHFTDCLFFGSLMSATDPVTVLAIFHELHVDPDLYTLLFGESVLNDAVAIVLTYSISIYSPKENPNAFDAAAFFQSVGNFLGIFAGSFAMGSAYAIITALLTKFTKLCEFPMLETGLFFLLSWSAFLSAEAAGLTGIVAVLFCGVTQAHYTYNNLSSDSKIRTKQLFEFMNFLAENVIFCYMGLALFTFQNHIFNALFILGAFLAIFVARACNIYPLSFLLNLGRKQKIPWNFQHMMMFSGLRGAIAFALAIRNTESQPKQMMFTTTLLLVFFTVWVFGGGTTPMLTWLQIRVGVDLDENLKEDPSSQHQEANNLDKNMTKAESARLFRMWYSFDHKYLKPILTHSGPPLTTTLPEWCGPISRLLTSPQAYGEQLKEDDVECIVNQDELAINYQEQASSPCSPPARLGLDQKASPQTPGKENIYEGDLGLGGYELKLEQTLGQSQLN

SEQ ID NO: 64885 - protein, 325 aa, Homo sapiens
LRLQSSWEQMTFDPEIFFNVLLPPIIFHAGYSLKKRHFFQNLGSILTYAFLGTAISCIVIGLIMYGFVKAMIHAGQLKNGDFHFTDCLFFGSLMSATDPVTVLAIFHELHVDPDLYTLLFGESVLNDAVAIVLTYSISIYSPKENPNAFDAAAFFQSVGNFLGIFAGSFAMGSAYAIITALLTKFTKLCEFPMLETGLFFLLSWSAFLSAEAAGLTGIVAVLFCGVTQAHYTYNNLSSDSKIRTKQLFEFMNFLAENVIFCYMGLALFTFQNHIFNALFILGAFVSIFLARAHTELKNLLFFLASFLCYFSHRSKGLPMAGCALP

SEQ ID NO: 64886 - protein, 1177 aa, Homo sapiens
MAGIFKEFFFSTEDLPEVILTLSLISSIGAFLNRHLEDFPIPVPVILFLLGCSFEVLSFTSSQVQRYANAIQWMSPDLFFRIFTPVVFFTTAFDMDTYMLQKLFWQILLISIPGFLVNYILVLWHLASVNQLLLKPTQWLLFSAILVSSDPMLTAAAIRDLGLSRSLISLINGESLMTSVISLITFTSIMDFDQRLQSKRNHTLAEEIVGGICSYIIASFLFGILSSKLIQFWMSTVFGDDVNHISLIFSILYLIFYICELVGMSGIFTLAIVGLLLNSTSFKAAIEETLLLEFWTFLSRIAFLMVFTFFGLLIPAHTYLYIEFVDIYYSLNIYLTLIVLRFLTLLLISPVLSRVGHEFSWRWIFIMVCSEMKGMPNINMALLLAYSDLYFGSDKEKSQILFHGVLVCLITLVVNRFILPVAVTILGLRDATSTKYKSVCCTFQHFQELTKSAASALKFDKDLANADWNMIEKAITLENPYMLNEEETTEHQKVKCPHCNKEIDEIFNTEAMELANRRLLSAQIASYQRQYRNEILSQSAVQVLVGAAESFGEKKGKCMSLDTIKNYSESQKTVTFARKLLLNWVYNTRKEKEGPSKYFFFRICHTIVFTEEFEHVGYLVILMNIFPFIISWISQLNVIYHSELKHTNYCFLTLYILEALLKIAAMRKDFFSHAWNIFELAITLIGILHVILIEIDTIKYIFNETEVIVFIKVVQFFRILRIFKLIAPKLLQIIDKRMSHQKTFWYGILKGYVQGEADIMTIIDQITSSKQIKQMLLKQVIRNMEHAIKELGYLEYDHPEIAVTVKTKEEINVMLNMATEILKAFGLKGIISKTEGAGINKLIMAKKKEVLDSQSIIRPLTVEEVLYHIPWLDKNKDYINFIQEKAKVVTFDCGNDIFEEGDEPKGIYIIISGMVKLEKSKPGLGIDQMVESKEKDFPIIDTDYMLSGEIIGEINCLTNEPMKYSATCKTVVETCFIPKTHLYDAFEQCSPLIKQKMWLKLGLAITARKIREHLSYEDWNYNMQLKLSNIYVVDIPMSTKTDIYDENLIYVILIHGAVEDCLLRKTYRAPFLIPITCHQIQSIEDFTKVVIIQTPINMKTFRRNIRKFVPKHKSYLTPGLIGSVGTLEEGIQEERNVKEDGAHSAATARSPQPCSLLGTKFNCKESPRINLRKVRKE

SEQ ID NO: 64887 - protein, 1129 aa, Homo sapiens
MAGIFKEFFFSTEDLPEVILTLSLISSIGAFLNRHLEDFPIPVPVILFLLGCSFEVLSFTSSQVQRYANAIQWMSPDLFFRIFTPVVFFTTAFDMDTYMLQKLFWQILLISIPGFLVNYILVLWHLASVNQLLLKPTQWLLFSAILVSSDPMLTAAAIRDLGLSRSLISLINGESLMTSVISLITFTSIMDFDQRLQSKRNHTLAEEIVGGICSYIIASFLFGILSSKLIQFWMSTVFGDDVNHISLIFSILYLIFYICELVGMSGIFTLAIVGLLLNSTSFKAAIEETLLLEFLTLLLISPVLSRVGHEFSWRWIFIMVCSEMKGMPNINMALLLAYSDLYFGSDKEKSQILFHGVLVCLITLVVNRFILPVAVTILGLRDATSTKYKSVCCTFQHFQELTKSAASALKFDKDLANADWNMIEKAITLENPYMLNEEETTEHQKVKCPHCNKEIDEIFNTEAMELANRRLLSAQIASYQRQYRNEILSQSAVQVLVGAAESFGEKKGKCMSLDTIKNYSESQKTVTFARKLLLNWVYNTRKEKEGPSKYFFFRICHTIVFTEEFEHVGYLVILMNIFPFIISWISQLNVIYHSELKHTNYCFLTLYILEALLKIAAMRKDFFSHAWNIFELAITLIGILHVILIEIDTIKYIFNETEVIVFIKVVQFFRILRIFKLIAPKLLQIIDKRMSHQKTFWYGILKGYVQGEADIMTIIDQITSSKQIKQMLLKQVIRNMEHAIKELGYLEYDHPEIAVTVKTKEEINVMLNMATEILKAFGLKGIISKTEGAGINKLIMAKKKEVLDSQSIIRPLTVEEVLYHIPWLDKNKDYINFIQEKAKVVTFDCGNDIFEEGDEPKGIYIIISGMVKLEKSKPGLGIDQMVESKEKDFPIIDTDYMLSGEIIGEINCLTNEPMKYSATCKTVVETCFIPKTHLYDAFEQCSPLIKQKMWLKLGLAITARKIREHLSYEDWNYNMQLKLSNIYVVDIPMSTKTDIYDENLIYVILIHGAVEDCLLRKTYRAPFLIPITCHQIQSIEDFTKVVIIQTPINMKTFRRNIRKFVPKHKSYLTPGLIGSVGTLEEGIQEERNVKEDGAHSAATARSPQPCSLLGTKFNCKESPRINLRKVRKE

SEQ ID NO: 64888 - protein, 692 aa, Homo sapiens
MQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITPDDPRWIGAWWGGFLLCGALLFFSSLLMFGFPQSLPPHSEPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGFIPPPLIFGAGIDSTCLFWSTFCGEQGACVLYDNVVYRYLYVSIAIALKSFAFILYTTTWQCLRKNYKRYIKNHEGGLSTSTEYQDIETEKTCPESHSPSEDSFVRS

SEQ ID NO: 64889 - protein, 691 aa, Homo sapiens
MDQNQHLNKTAEAQPSENKKTRYCNGLKMFLAALSLSFIAKTLGAIIMKSSIIHIERRFEISSSLVGFIDGSFEIGNLLVIVFVSYFGSKLHRPKLIGIGCFIMGIGGVLTALPHFFMGYYRYSKETNINSSENSTSTLSTCLINQILSLNRASPEIVGKGCLKESGSYMWIYVFMGNMLRGIGETPIVPLGLSYIDDFAKEGHSSLYLGILNAIAMIGPIIGFTLGSLFSKMYVDIGYVDLSTIRITPTDSRWVGAWWLNFLVSGLFSIISSIPFFFLPQTPNKPQKERKASLSLHVLETNDEKDQTANLTNQGKNITKNVTGFFQSFKSILTNPLYVMFVLLTLLQVSSYIGAFTYVFKYVEQQYGQPSSKANILLGVITIPIFASGMFLGGYIIKKFKLNTVGIAKFSCFTAVMSLSFYLLYFFILCENKSVAGLTMTYDGNNPVTSHRDVPLSYCNSDCNCDESQWEPVCGNNGITYISPCLAGCKSSSGNKKPIVFYNCSCLEVTGLQNRNYSAHLGECPRDDACTRKFYFFVAIQVLNLFFSALGGTSHVMLIVKIVQPELKSLALGFHSMVIRALGGILAPIYFGALIDTTCIKWSTNNCGTRGSCRTYNSTSFSRVYLGLSSMLRVSSLVLYIILIYAMKKKYQEKDINASENGSVMDEANLESLNKNKHFVPSAGADSETHC

SEQ ID NO: 64890 - protein, 702 aa, Homo sapiens
MDQHQHLNKTAESASSEKKKTRRCNGFKMFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETHINPSENSTSSLSTCLINQTLSFNGTSPEIVEKDCVKESGSHMWIYVFMGNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTVFYNCSCVEVTGLQNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGRVYLGLSIALRFPALVLYIVFIFAMKKKFQGKDTKASDNERKVMDEANLEFLNNGEHFVPSAGTDSKTCNLDMQDNAAAN

SEQ ID NO: 64891 - protein, 702 aa, Homo sapiens; identical to SEQ ID NO: 64890

SEQ ID NO: 64892 - protein, 748 aa, Homo sapiens
MDQHQHLNKTAESASSEKKKTRRCNGFKMFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETHINPSENSTSSLSTCLINQTLSFNGTSPEIVEKDCVKESGSHMWIYVFMGNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTVFYNCSCVEVTGLQNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGIVQPELKALAIGFHSMIMRSLGGILVPIYFGALIDTTCMKWSTNSCGARGACRIYNSTYLGRAFFGLKVALIFPVLVLLTVFIFVVRKKSHGKDTKVLENERQVMDEANLEFLNDSEHFVPSAEEQ

SEQ ID NO: 64893 - protein, 712 aa, Homo sapiens
MDTSSKENIQLFCKTSVQPVGRPSFKTEYPSSEEKQPCCGELKVFLCALSFVYFAKALAEGYLKSTITQIERRFDIPSSLVGVIDGSFEIGNLLVITFVSYFGAKLHRPKIIGAGCVIMGVGTLLIAMPQFFMEQYKYERYSPSSNSTLSISPCLLESSSQLPVSVMEKSKSKISNECEVDTSSSMWIYVFLGNLLRGIGETPIQPLGIAYLDDFASEDNAAFYIGCVQTVAIIGPIFGFLLGSLCAKLYVDIGFVNLDHITITPKDPQWVGAWWLGYLIAGIISLLAAVPFWYLPKSLPRSQSREDSNSSSEKSKFIIDDHTDYQTPQGENAKIMEMARDFLPSLKNLFGNPVYFLYLCTSTVQFNSLFGMVTYKPKYIEQQYGQSSSRANFVIGLINIPAVALGIFSGGIVMKKFRISVCGAAKLYLGSSVFGYLLFLSLFALGCENSDVAGLTVSYQGTKPVSYHERALFSDCNSRCKCSETKWEPMCGENGITYVSACLAGCQTSNRSGKNIIFYNCTCVGIAASKSGNSSGIVGRCQKDNGCPQMFLYFLVISVITSYTLSLGGIPGYILLLRCIKPQLKSFALGIYTLAIRVLAGIPAPVYFGVLIDTSCLKWGFKRCGSRGSCRLYDSNVFRHIYLGLTVILGTVSILLSIAVLFILKKNYVSKHRSFITKRERTMVSTRFQKENYTTSDHLLQPNYWPGKETQL

SEQ ID NO: 64894 - protein, 730 aa, Homo sapiens
MDTSSKENIQLFCKTSVQPVGRPSFKTEYPSSEEKQPCCGELKVFLCALSFVYFAKALAEGYLKSTITQIERRFDIPSSLVGVIDGSFEIGNLLVITFVSYFGAKLHRPKIIGAGCVIMGVGTLLIAMPQFFMEQYKYERYSPSSNSTLSISPCLLESSSQLPVSVMEKSKSKISNECEVDTSSSMWIYVFLGNLLRGIGETPIQPLGIAYLDDFASEDNAAFYIGCVQTVAIIGPIFGFLLGSLCAKLYVDIGFVNLDHITITPKDPQWVGAWWLGYLIAGIISLLAAVPFWYLPKSLPRSQSREDSNSSSEKSKFIIDDHTDYQTPQGENAKIMEMARDFLPSLKNLFGNPVYFLYLCTSTVQFNSLFGMVTYKPKYIEQQYGQSSSRANFVIGLINIPAVALGIFSGGIVMKKFRISVCGAAKLYLGSSVFGYLLFLSLFALGCENSDVAGLTVSYQGTKPVSYHERALFSDCNSRCKCSETKWEPMCGENGITYVSACLAGCQTSNRSGKNIIFYNCTCVGIAASKSGNSSGIVGRCQKDNGCPQMFLYFLVISVITSYTLSLGGIPGYILLLRCIKPQLKSFALGIYTLAIRVLAGIPAPVYFGVLIDTSCLKWGFKRCGSRGSCRLYDSNVFRYQIKSIPASHCYSIPDLHNATDTNKFSCHFTACKTYISGTNCDTGHSVNSPKHCSTFHFKEKLCFKTQKFYNQERKNNGVYKIPKGKLHYK

SEQ ID NO: 64895 - protein, 663 aa, Homo sapiens
MDTSSKENIQLFCKTSVQPVGRPSFKTEYPSSEEKQPCCGELKVFLCALSFVYFAKALAEGYLKSTITQIERRFDIPSSLVGVIDGSFEIGNLLVITFVSYFGAKLHRPKIIGAGCVIMGVGTLLIAMPQFFMEQYKYERYSPSSNSTLSISPCLLESSSQLPVSVMEKSKSKISNGCVQTVAIIGPIFGFLLGSLCAKLYVDIGFVNLDHITITPKDPQWVGAWWLGYLIAGIISLLAAVPFWYLPKSLPRSQSREDSNSSSEKSKFIIDDHTDYQTPQGENAKIMEMARDFLPSLKNLFGNPVYFLYLCTSTVQFNSLFGMVTYKPKYIEQQYGQSSSRANFVIGLINIPAVALGIFSGGIVMKKFRISVCGAAKLYLGSSVFGYLLFLSLFALGCENSDVAGLTVSYQGTKPVSYHERALFSDCNSRCKCSETKWEPMCGENGITYVSACLAGCQTSNRSGKNIIFYNCTCVGIAASKSGNSSGIVGRCQKDNGCPQMFLYFLVISVITSYTLSLGGIPGYILLLRCIKPQLKSFALGIYTLAIRVLAGIPAPVYFGVLIDTSCLKWGFKRCGSRGSCRLYDSNVFRHIYLGLTVILGTVSILLSIAVLFILKKNYVSKHRSFITKRERTMVSTRFQKENYTTSDHLLQPNYWPGKETQL

SEQ ID NO: 64896 - protein, 612 aa, Homo sapiens
MGVGTLLIAMPQFFMEQYKYERYSPSSNSTLSISPCLLESSSQLPVSVMEKSKSKISNECEVDTSSSMWIYVFLGNLLRGIGETPIQPLGIAYLDDFASEDNAAFYIGCVQTVAIIGPIFGFLLGSLCAKLYVDIGFVNLDHITITPKDPQWVGAWWLGYLIAGIISLLAAVPFWYLPKSLPRSQSREDSNSSSEKSKFIIDDHTDYQTPQGENAKIMEMARDFLPSLKNLFGNPVYFLYLCTSTVQFNSLFGMVTYKPKYIEQQYGQSSSRANFVIGLINIPAVALGIFSGGIVMKKFRISVCGAAKLYLGSSVFGYLLFLSLFALGCENSDVAGLTVSYQGTKPVSYHERALFSDCNSRCKCSETKWEPMCGENGITYVSACLAGCQTSNRSGKNIIFYNCTCVGIAASKSGNSSGIVGRCQKDNGCPQMFLYFLVISVITSYTLSLGGIPGYILLLRCIKPQLKSFALGIYTLAIRVLAGIPAPVYFGVLIDTSCLKWGFKRCGSRGSCRLYDSNVFRYQIKSIPASHCYSIPDLHNATDTNKFSCHFTACKTYISGTNCDTGHSVNSPKHCSTFHFKEKLCFKTQKFYNQERKNNGVYKIPKGKLHYK

SEQ ID NO: 64897 - protein, 730 aa, Homo sapiens; identical to SEQ ID NO: 64894

SEQ ID NO: 64898 - protein, 643 aa, Homo sapiens [sequence omitted]

SEQ ID NO: 64899 - protein, 415 aa, Homo sapiens
MGLLPKLGASQGSDTSTSRAGRCARSVFGNIKVFVLCQGLLQLCQLLYSAYFKSSLTTIEKRFGLSSSSSGLISSLNEISNAILIIFVSYFGSRVHRPRLIGIGGLFLAAGAFILTLPHFLSEPYQYTLASTGNNSRLQAELCQKHWQDLPPSKCHSTTQNPQKETSSMWGLMVVAQLLAGIGTVPIQPFGISYVDDFSEPSNSPLYISILFAISVFGPAFGYLLGSVMLQIFVDYGRVNTAAVNLVPGDPRWIGAWWLGLLISSALLVLTSFPFFFFPRAMPIGAKRAPATADEARKLEEAKSRGSLVDFIKRFPCIFLRLLMNSLFVLVVLAQCTFSSVIAGLSTFLNKFLEKQYGTSAAYANFLIAHQVLYIRSLLPAAGTARAQILSSTRSVETMESSTSPLAMPAAATST

SEQ ID NO: 64900 - protein, 710 aa, Homo sapiens
MQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITPDDPRWIGAWWGGFLLCGALLFFSSLLMFGFPQSLPPHSEPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGFIPPPLIFGAGIDSTCLFWSTFCGEQGACVLYDNVVYRYLYVSIAIALKSFAFILYTTTWQCLRKNYKRYIKNHEGGLSTSEFFASTLTLDNLGRDPVPANQTHRTKFIYNLEDHEWCENMESVL

SEQ ID NO: 64901 - protein, 722 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKVLGVLFFAIACFLYKPLSESSDGLETCLPSQSSAPDSATDSQLQSSV

SEQ ID NO: 64902 - protein, 582 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKVLGVLFFAIASSRAASDHRPRPPGHGGHSAFPDDRTVPLGDAITRELLFDLQPST

SEQ ID NO: 64903 - protein, 722 aa, Homo sapiens; identical to SEQ ID NO: 64901

SEQ ID NO: 64904 - protein, 722 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTFLYIPQQHSCTNGNSTTGALQETPRSKRACRCVRDPQRSFALGIQWIVVRILGGIPGPIAFGWVIDKACLLWQDQCGQQGSCLVYQNSAMSRYILIMGLLYKVLGVLFFAIACFLYKPLSESSDGLETCLPSQSSAPDSATDSQLQSSV

SEQ ID NO: 64905 - protein, 151 aa, Homo sapiens
TTALCAARTASCTSHCATQGALQPRRRMWTARRCVRDPQRSFALGIQWIVVRILGGIPGPIAFGWVIDKACLLWQDQCGQQGSCLVYQNSAMSRYILIMGLLYKVLGVLFFAIACFLYKPLSESSDGLETCLPSQSSAPDSATDSQLQSSV

SEQ ID NO: 64906 - protein, 620 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVSGAAAYRPCPPLDPGKGPPCLPLVIGAIVGLPRCTETVAVSLRIFPLVLAMPLQGNALQLVRESPSFWFSYSL

SEQ ID NO: 64907 - protein, 719 aa, Homo sapiens
MFVGVARHSGSQDEVSRGVEPLEAARAQPAKDRRAKGTPKSSKPGKKHRYLRLLPEALIRFGGFRKRKKAKSSVSKKPGEVDDSLEQPCGLGCLVSTCCECCNNIRCFMIFYCILLICQGVVFGLIDVSIGDFQKEYQLKTIEKLALEKSYDISSGLVAIFIAFYGDRKKVIWFVASSFLIGLGSLLCAFPSINEENKQSKVGIEDICEEIKVVSGCQSSGISFQSKYLSFFILGQTVQGIAGMPLYILGITFIDENVATHSAGIYLGIAECTSMIGYALGYVLGAPLVKVPENTTSATNTTVNNGSPEWLWTWWINFLFAAVVAWCTLIPLSCFPNNMPGSTRIKARKRKQLHFFDSRLKDLKLGTNIKDLCAALWILMKNPVLICLALSKATEYLVIIGASEFLPIYLENQFILTPTVATTLAGLVLIPGGALGQLLGGVIVSTLEMSCKALMRFIMVTSVISLILLVFIIFVRCNPVQFAGINEDYDGTGKLGNLTAPCNEKCRCSSSIYSSICGRDDIEYFSPCFAGCTYSKAQNQKKMYYNCSCIKEGLITADAEGDFIDARPGKCDAKCYKLPLFIAFIFSTLIFSGFSGVPIVLAMTRVVPDKLRSLALGVSYVILRIFGTIPGPSIFKMSGETSCILRDVNKCGHTGRCWIYNKTKMAFLLVGICFLCKLCTIIFTTIAFFIYKRRLNENTDFPDVTVKNPKVKKKEETDL

SEQ ID NO: 64908 - protein, 466 aa, Homo sapiens
MFVGVARHSGSQDEVSRGVEPLEAARAQPAKDRRAKGTPKSSKPGKKHRYLRLLPEALIRFGGFRKRKKAKSSVSKKPGEVDDSLEQPCGLGCLVSTCCECCNNIRCFMIFYCILLICQGVVFGLIDVSIGDFQKEYQLKTIEKLALEKSYDISSGLVAIFIAFYGDRKKVIWFVASSFLIGLGSLLCAFPSINEENKQSKVGIEGIAECTSMIGYALGYVLGAPLVKVPENTTSATKTGKLGNLTAPCNEKCRCSSSIYSSICGRDDIEYFSPCFAGCTYSKAQNQKKMYYNCSCIKEGLITADAEGDFIDARPGKCDAKCYKLPLFIAFIFSTLIFSGFSGVPIVLAMTRVVPDKLRSLALGVSYVILRIFGTIPGPSIFKMSGETSCILRDVNKCGHTGRCWIYNKTKMAFLLVGICFLCKLCTIIFTTIAFFIYKRRLNENTDFPDVTVKNPKVKKKEETDL

SEQ ID NO: 64909 - protein, 657 aa, Homo sapiens
MFVGVARHSGSQDEVSRGVEPLEAARAQPAKDRRAKGTPKSSKPGKKHRYLRLLPEALIRFGGFRKRKKAKSSVSKKPGEVDDSLEQPCGLGCLVSTCCECCNNIRCFMIFYCILLICQGVVFGLIDVSIGDFQKEYQLKTIEKLALEKSYDISSGLVAIFIAFYGDRKKVIWFVASSFLIGLGSLLCAFPSINEENKQSKVGIEGIAECTSMIGYALGYVLGAPLVKVPENTTSATNTTVNNGSPEWLWTWWINFLFAAVVAWCTLIPLSCFPNNMPGSTRIKARKRKQLHFFDSRLKDLKLGTNIKDLCAALWILMKNPVLICLALSKATEYLVIIGASEFLPIYLENQFILTPTVATTLAGLVLIPGGALGQLLGGVIVSTLEMSCKALMRFIMVTSVISLILLVFIIFVRCNPVQFAGINEDYDGTGKLGNLTAPCNEKCRCSSSIYSSICGRDDIEYFSPCFAGCTYSKAQNQKKMYYNCSCIKEGLITADAEGDFIDARPGKCDAKCYKLPLFIAFIFSTLIFSGFSGVPIVLAMTRVVPDKLRSLALGVSYVILRIFGTIPGPSIFKMSGETSCILRDVNKCGHTGRCWIYNKTKMAFLLVGICFLCKLCTIIFTTIAFFIYKRRLNENTDFPDVTVKNPKVKKKEETDL

SEQ ID NO: 64910 - protein, 719 aa, Homo sapiens; identical to SEQ ID NO: 64907

SEQ ID NO: 64911 - protein, 25 aa, Homo sapiens
LNENTDFPDVTVKNPKVKKKEETDL

SEQ ID NO: 64912 - protein, 466 aa, Homo sapiens; identical to SEQ ID NO: 64908

SEQ ID NO: 64913 - protein, 116 aa, Homo sapiens
MLSCRLQCALAALSIVLALGCVTGAPSDPRLRQFLQKSLAAAAGKQELAKYFLAELLSEPNQTENDALEPEDLSQAAEQDEMRLELQRSANSNPAMAPRERKAGCKNFFWKTFTSC

SEQ ID NO: 64914 - protein, 391 aa, Homo sapiens
MFPNGTASSPSSSPSPSPGSCGEGGGSRGPGAGAADGMEEPGRNASQNGTLSEGQGSAILISFIYSVVCLVGLCGNSMVIYVILRYAKMKTATNIYILNLAIADELLMLSVPFLVTSTLLRHWPFGALLCRLVLSVDAVNMFTSIYCLTVLSVDRYVAVVHPIKAARYRRPTVAKVVNLGVWVLSLLVILPIVVFSRTAANSDGTVACNMLMPEPAQRWLVGFVLYTFLMGFLLPVGAICLCYVLIIAKMRMVALKAGWQQRKRSERKITLMVMMVVMVFVICWMPFYVVQLVNVFAEQDDATVSQLSVILGYANSCANPILYGFLSDNFKRSFQRILCLSWMDNAAEEPVDYYATALKSRAYSVEDFQPENLESGGVFRNGTCTSRITTL

SEQ ID NO: 64915 - protein, 418 aa, Homo sapiens
MDMLHPSSVSTTSEPENASSAWPPDATLGNVSAGPSPAGLAVSGVLIPLVYLVVCVVGLLGNSLVIYVVLRHTASPSVTNVYILNLALADELFMLGLPFLAAQNALSYWPFGSLMCRLVMAVDGINQFTSIFCLTVMSVDRYLAVVHPTRSARWRTAPVARTVSAAVWVASAVVVLPVVVFSGVPRGMSTCHMQWPEPAAAWRAGFIIYTAALGFFGPLLVICLCYLLIVVKVRSAGRRVWAPSCQRRRRSERRVTRMVVAVVALFVLCWMPFYVLNIVNVVCPLPEEPAFFGLYFLVVALPYANSCANPILYGFLSYRFKQGFRRVLLRPSRRVRSQEPTVGPPEKTEEEDEEEEDGEESREGGKGKEMNGRVSQITQPGTSGQERPPSRVASKEQQLLPQEASTGEKSSTMRISYL

SEQ ID NO: 64916 - protein, 418 aa, Homo sapiens; identical to SEQ ID NO: 64915

SEQ ID NO: 64917 - protein, 388 aa, Homo sapiens
MSAPSTLPPGGEEGLGTAWPSAANASSAPAEAEEAVAGPGDARAAGMVAIQCIYALVCLVGLVGNALVIFVILRYAKMKTATNIYLLNLAVADELFMLSVPFVASSAALRHWPFGSVLCRAVLSVDGLNMFTSVFCLTVLSVDRYVAVVHPLRAATYRRPSVAKLINLGVWLASLLVTLPIAIFADTRPARGGQAVACNLQWPHPAWSAVFVVYTFLLGFLLPVLAIGLCYLLIVGKMRAVALRAGWQQRRRSEKKITRLVLMVVVVFVLCWMPFYVVQLLNLFVTSLDATVNHVSLILSYANSCANPILYGFLSDNFRRFFQRVLCLRCCLLEGAGGAEEEPLDYYATALKSKGGAGCMCPPLPCQQEALQPEPGRKRIPLTRTTTF

SEQ ID NO: 64918 - protein, 364 aa, Homo sapiens
MEPLFPASTPSWNASSPGAASGGGDNRTLVGPAPSAGARAVLVPVLYLLVCAAGLGGNTLVIYVVLRFAKMKTVTNIYILNLAVADVLYMLGLPFLATQNAASFWPFGPVLCRLVMTLDGVNQFTSVFCLTVMSVDRYLAVVHPLSSARWRRPRVAKLASAAAWVLSLCMSLPLLVFADVQEGGTCNASWPEPVGLWGAVFIIYTAVLGFFAPLLVICLCYLLIVVKVRAAGVRVGCVRRRSERKVTRMVLVVVLVFAGCWLPFFTVNIVNLAVALPQEPASAGLYFFVVILSYANSCANPVLYGFLSDNFRQSFQKVLCLRKGSGAKDADATEPRPDRIRQQQEATPPAHRAAANGLMQTSKL

SEQ ID NO: 64919 - protein, 364 aa, Homo sapiens; identical to SEQ ID NO: 64918

SEQ ID NO: 64920 - protein, 273 aa, Homo sapiens
MEPLFPASTPSWNASSPGAASGGGDNRTLVGPAPSAGARAVLVPVLYLLVCAAGLGGNTLVIYVVLRFAKMKTVTNIYILNLAVADVLYMLGLPFLATQNAASFWPFGPVLCRLVMTLDGVNQFTSVFCLTVMSVDRYLAVVHPLSSARWRRPRVAKLASAAAWVLSLCMSLPLLVFADVQEGGTCNASWPEPVGLWGAVFIIYTAVLGFFAPLLRGSGRAGDANGRPWESRRLPPRIVLPPPPQTPAFPGAPGPERGPREPCWGLWGTLALL

SEQ ID NO: 64921 - protein, 2325 aa, Homo sapiens
MATNIEQIFRSFVVSKFREIQQELSSGRNEGQLNGETNTPIEGNQAGDAAASARSLPNEEIVQKIEEVLSGVLDTELRYKPDLKEGSRKSRCVSVQTDPTDEIPTKKSKKHKKHKNKKKKKKKEKEKKYKRQPEESESKTKSHDDGNIDLESDSFLKFDSEPSAVALELPTRAFGPSETNESPAVVLEPPVVSMEVSEPHILETLKPATKTAELSVVSTSVISEQSEQSVAVMPEPSMTKILDSFAAAPVPTTTLVLKSSEPVVTMSVEYQMKSVLKSVESTSPEPSKIMLVEPPVAKVLEPSETLVVSSETPTEVYPEPSTSTTMDFPESSAIEALRLPEQPVDVPSEIADSSMTRPQELPELPKTTALELQESSVASAMELPGPPATSMPELQGPPVTPVLELPGPSATPVPELPGPLSTPVPELPGPPATAVPELPGPSVTPVPQLSQELPGLPAPSMGLEPPQEVPEPPVMAQELPGLPLVTAAVELPEQPAVTVAMELTEQPVTTTELEQPVGMTTVEHPGHPEVTTATGLLGQPEATMVLELPGQPVATTALELPGQPSVTGVPELPGLPSATRALELSGQPVATGALELPGPLMAAGALEFSGQSGAAGALELLGQPLATGVLELPGQPGAPELPGQPVATVALEISVQSVVTTSELSTMTVSQSLEVPSTTALESYNTVAQELPTTLVGETSVTVGVDPLMAPESHILASNTMETHILASNTMDSQMLASNTMDSQMLASNTMDSQMLASSTMDSQMLATSSMDSQMLATSSMDSQMLATSTMDSQMLATSSMDSQMLATSSMDSQMLATSSMDSQMLATSSMDSQMLATSTMDSQMLATSTMDSQMLATSSMDSQMLASGTMDSQMLASGTMDAQMLASGTMDAQMLASSTQDSAMLGSKSPDPYRLAQDPYRLAQDPYRLGHDPYRLGHDAYRLGQDPYRLGHDPYRLTPDPYRMSPRPYRIAPRSYRIAPRPYRLAPRPLMLASRRSMMMSYAAERSMMSSYERSMMSYERSMMSPMAERSMMSAYERSMMSAYERSMMSPMAERSMMSAYERSMMSAYERSMMSPMADRSMMSMGADRSMMSSYSAADRSMMSSYSAADRSMMSSYTADRSMMSMAADSYTDSYTDTYTEAYMVPPLPPEEPPTMPPLPPEEPPMTPPLPPEEPPEGPALPTEQSALTAENTWPTEVPSSPSEESVSQPEPPVSQSEISEPSAVPTDYSVSASDPSVLVSEAAVTVPEPPPEPESSITLTPVESAVVAEEHEVVPERPVTCMVSETPAMSAEPTVLASEPPVMSETAETFDSMRASGHVASEVSTSLLVPAVTTPVLAESILEPPAMAAPESSAMAVLESSAVTVLESSTVTVLESSTVTVLEPSVVTVPEPPVVAEPDYVTIPVPVVSALEPSVPVLEPAVSVLQPSMIVSEPSVSVQESTVTVSEPAVTVSEQTQVIPTEVAIESTPMILESSIMSSHVMKGINLSSGDQNLAPEIGMQEIALHSGEEPHAEEHLKGDFYESEHGINIDLNINNHLIAKEMEHNTVCAAGTSPVGEIGEEKILPTSETKQRTVLDTYPGVSEADAGETLSSTGPFALEPDATGTSKGIEFTTASTLSLVNKYDVDLSLTTQDTEHDMVISTSPSGGSEADIEGPLPAKDIHLDLPSNNNLVSKDTEEPLPVKESDQTLAALLSPKESSGGEKEVPPPPKETLPDSGFSANIEDINEADLVRPLLPKDMERLTSLRAGIEGPLLASDVGRDRSAASPVVSSMPERASESSSEEKDDYEIFVKVKDTHEKSKKNKNRDKGEKEKKRDSSLRSRSKRSKSSEHKSRKRTSESRSRARKRSSKSKSHRSQTRSRSRSRRRRRSSRSRSKSRGRRSVSKEKRKRSPKHRSKSRERKRKRSSSRDNRKTVRARSRTPSRRSRSHTPSRRRRSRSVGRRRSFSISPSRRSRTPSRRSRTPSRRSRTPSRRSRTPSRRSRTPSRRSRTPSRRRRSRSVVRRRSFSISPVRLRRSRTPLRRRFSRSPIRRKRSRSSERGRSPKRLTDLDKAQLLEIAKANAAAMCAKAGVPLPPNLKPAPPPTIEEKVAKKSGGATIEELTEKCKQIAQSKEDDDVIVNKPHVSDEEEEEPPFYHHPFKLSEPKPIFFNLNIAAAKPTPPKSQVTLTKEFPVSSGSQHRKKEADSVYGEWVPVEKNGEENKDDDNVFSSNLPSEPVDISTAMSERALAQKRLSENAFDLEAMSMLNRAQERIDAWAQLNSIPGQFTGSTGVQVLTQEQLANTGAQAWIKKGQILVAVFLPRSVPAVLFTTLLLPRPRISS

SEQ ID NO: 64922 - protein, 2303 aa, Homo sapiens
MATNIEQIFRSFVVSKFREIQQELSSGRNEGQLNGETNTPIEGNQAGDAAASARSLPNEEIVQKIEEVLSGVLDTELRYKPDLKEGSRKSRCVSVQTDPTDEIPTKKSKKHKKHKNKKKKKKKEKEKKYKRQPEESESKTKSHDDGNIDLESDSFLKFDSEPSAVALELPTRAFGPSETNESPAVVLEPPVVSMEVSEPHILETLKPATKTAELSVVSTSVISEQSEQSVAVMPEPSMTKILDSFAAAPVPTTTLVLKSSEPVVTMSVEYQMKSVLKSVESTSPEPSKIMLVEPPVAKVLEPSETLVVSSETPTEVYPEPSTSTTMDFPESSAIEALRLPEQPVDVPSEIADSSMTRPQELPELPKTTALELQESSVASAMELPGPPATSMPELQGPPVTPVLELPGPSATPVPELPGPLSTPVPELPGPPATAVPELPGPSVTPVPQLSQELPGLPAPSMGLEPPQEVPEPPVMAQELPGLPLVTAAVELPEQPAVTVAMELTEQPVTTTELEQPVGMTTVEHPGHPEVTTATGLLGQPEATMVLELPGQPVATTALELPGQPSVTGVPELPGLPSATRALELSGQPVATGALELPGPLMAAGALEFSGQSGAAGALELLGQPLATGVLELPGQPGAPELPGQPVATVALEISVQSVVTTSELSTMTVSQSLEVPSTTALESYNTVAQELPTTLVGETSVTVGVDPLMAPESHILASNTMETHILASNTMDSQMLASNTMDSQMLASNTMDSQMLASSTMDSQMLATSSMDSQMLATSSMDSQMLATSTMDSQMLATSSMDSQMLATSSMDSQMLATSSMDSQMLATSSMDSQMLATSTMDSQMLATSTMDSQMLATSSMDSQMLASGTMDSQMLASGTMDAQMLASGTMDAQMLASSTQDSAMLGSKSPDPYRLAQDPYRLAQDPYRLGHDPYRLGHDAYRLGQDPYRLGHDPYRLTPDPYRMSPRPYRIAPRSYRIAPRPYRLAPRPLMLASRRSMMMSYAAERSMMSSYERSMMSYERSMMSPMAERSMMSAYERSMMSAYERSMMSPMAERSMMSAYERSMMSAYERSMMSPMADRSMMSMGADRSMMSSYSAADRSMMSSYSAADRSMMSSYTADRSMMSMAADSYTDSYTDTYTEAYMVPPLPPEEPPTMPPLPPEEPPMTPPLPPEEPPEGPALPTEQSALTAENTWPTEVPSSPSEESVSQPEPPVSQSEISEPSAVPTDYSVSASDPSVLVSEAAVTVPEPPPEPESSITLTPVESAVVAEEHEVVPERPVTCMVSETPAMSAEPTVLASEPPVMSETAETFDSMRASGHVASEVSTSLLVPAVTTPVLAESILEPPAMAAPESSAMAVLESSAVTVLESSTVTVLESSTVTVLEPSVVTVPEPPVVAEPDYVTIPVPVVSALEPSVPVLEPAVSVLQPSMIVSEPSVSVQESTVTVSEPAVTVSEQTQVIPTEVAIESTPMILESSIMSSHVMKGINLSSGDQNLAPEIGMQEIALHSGEEPHAEEHLKGDFYESEHGINIDLNINNHLIAKEMEHNTVCAAGTSPVGEIGEEKILPTSETKQRTVLDTYPGVSEADAGETLSSTGPFALEPDATGTSKGIEFTTASTLSLVNKYDVDLSLTTQDTEHDMVISTSPSGGSEADIEGPLPAKDIHLDLPSNNNLVSKDTEEPLPVKESDQTLAALLSPKESSGGEKEVPPPPKETLPDSGFSANIEDINEADLVRPLLPKDMERLTSLRAGIEGPLLASDVGRDRSAASPVVSSMPERASESSSEEKDDYEIFVKVKDTHEKSKKNKNRDKGEKEKKRDSSLRSRSKRSKSSEHKSRKRTSESRSRARKRSSKSKSHRSQTRSRSRSRRRRRSSRSRSKSRGRRSVSKEKRKRSPKHRSKSRERKRKRSSSRDNRKTVRARSRTPSRRSRSHTPSRRRRSRSVGRRRSFSISPSRRSRTPSRRSRTPSRRSRTPSRRSRTPSRRSRTPSRRSRTPSRRRRSRSVVRRRSFSISPVRLRRSRTPLRRRFSRSPIRRKRSRSSERGRSPKRLTDLDKAQLLEIAKANAAAMCAKAGVPLPPNLKPAPPPTIEEKVAKKSGGATIEELTEKCKQIAQSKEDDDVIVNKPHVSDEEEEEPPFYHHPFKLSEPKPIFFNLNIAAAKPTPPKSQVTLTKEFPVSSGSQHRKKEADSVYGEWVPVEKNGEENKDDDNVFSSNLPSEGRVKRQGRVRRQMKQPAASHLTVTRCNSLCGTKPQSEKHRIAENSVITSLPNIGPSLHLWEGSPRYNYLASRFASRLYSSRFWW

SEQ ID NO: 64923 - protein, 2426 aa, Homo sapiens
MATNIEQIFRSFVVSKFREIQQELSSGRNEGQLNGETNTPIEGNQAGDAAASARSLPNEEIVQKIEEVLSGVLDTELRYKPDLKEGSRKSRCVSVQTDPTDEIPTKKSKKHKKHKNKKKKKKKEKEKKYKRQPEESESKTKSHDDGNIDLESDSFLKFDSEPSAVALELPTRAFGPSETNESPAVVLEPPVVSMEVSEPHILETLKPATKTAELSVVSTSVISEQSEQSVAVMPEPSMTKILDSFAAAPVPTTTLVLKSSEPVVTMSVEYQMKSVLKSVESTSPEPSKIMLVEPPVAKVLEPSETLVVSSETPTEVYPEPSTSTTMDFPESSAIEALRLPEQPVDVPSEIADSSMTRPQELPELPKTTALELQESSVASAMELPGPPATSMPELQGPPVTPVLELPGPSATPVPELPGPLSTPVPELPGPPATAVPELPGPSVTPVPQLSQELPGLPAPSMGLEPPQEVPEPPVMAQELPGLPLVTAAVELPEQPAVTVAMELTEQPVTTTELEQPVGMTTVEHPGHPEVTTATGLLGQPEATMVLELPGQPVATTALELPGQPSVTGVPELPGLPSATRALELSGQPVATGALELPGPLMAAGALEFSGQSGAAGALELLGQPLATGVLELPGQPGAPELPGQPVATVALEISVQSVVTTSELSTMTVSQSLEVPSTTALESYNTVAQELPTTLVGETSVTVGVDPLMAPESHILASNTMETHILASNTMDSQMLASNTMDSQMLASNTMDSQMLASSTMDSQMLATSSMDSQMLATSSMDSQMLATSTMDSQMLATSSMDSQMLATSSMDSQMLATSSMDSQMLATSSMDSQMLATSTMDSQMLATSTMDSQMLATSSMDSQMLASGTMDSQMLASGTMDAQMLASGTMDAQMLASSTQDSAMLGSKSPDPYRLAQDPYRLAQDPYRLGHDPYRLGHDAYRLGQDPYRLGHDPYRLTPDPYRMSPRPYRIAPRSYRIAPRPYRLAPRPLMLASRRSMMMSYAAERSMMSSYERSMMSYERSMMSPMAERSMMSAYERSMMSAYERSMMSPMAERSMMSAYERSMMSAYERSMMSPMADRSMMSMGADRSMMSSYSAADRSMMSSYSAADRSMMSSYTADRSMMSMAADSYTDSYTDTYTEAYMVPPLPPEEPPTMPPLPPEEPPMTPPLPPEEPPEGPALPTEQSALTAENTWPTEVPSSPSEESVSQPEPPVSQSEISEPSAVPTDYSVSASDPSVLVSEAAVTVPEPPPEPESSITLTPVESAVVAEEHEVVPERPVTCMVSETPAMSAEPTVLASEPPVMSETAETFDSMRASGHVASEVSTSLLVPAVTTPVLAESILEPPAMAAPESSAMAVLESSAVTVLESSTVTVLESSTVTVLEPSVVTVPEPPVVAEPDYVTIPVPVVSALEPSVPVLEPAVSVLQPSMIVSEPSVSVQESTVTVSEPAVTVSEQTQVIPTEVAIESTPMILESSIMSSHVMKGINLSSGDQNLAPEIGMQEIALHSGEEPHAEEHLKGDFYESEHGINIDLNINNHLIAKEMEHNTVCAAGTSPVGEIGEEKILPTSETKQRTVLDTYPGVSEADAGETLSSTGPFALEPDATGTSKGIEFTTASTLSLVNKYDVDLSLTTQDTEHDMVISTSPSGGSEADIEGPLPAKDIHLDLPSNNNLVSKDTEEPLPVKESDQTLAALLSPKESSGGEKEVPPPPKETLPDSGFSANIEDINEADLVRPLLPKDMERLTSLRAGIEGPLLASDVGRDRSAASPVVSSMPERASESSSEEKDDYEIFVKVKDTHEKSKKNKNRDKGEKEKKRDSSLRSRSKRSKSSEHKSRKRTSESRSRARKRSSKSKSHRSQTRSRSRSRRRRRSSRSRSKSRGRRSVSKEKRKRSPKHRSKSRERKRKRSSSRDNRKTVRARSRTPSRRSRSHTPSRRRRSRSVGRRRSFSISPSRRSRTPSRRSRTPSRRSRTPSRRSRTPSRRSRTPSRRSRTPSRRRRSRSVVRRRSFSISPVRLRRSRTPLRRRFSRSPIRRKRSRSSERGRSPKRLTDLDKAQLLEIAKANAAAMCAKAGVPLPPNLKPAPPPTIEEKVAKKSGGATIEELTEKCKQIAQSKEDDDVIVNKPHVSDEEEEEPPFYHHPFKLSEPKPIFFNLNIAAAKPTPPKSQVTLTKEFPVSSGSQHRKKEADSVYGEWVPVEKNGEENKDDDNVFSSNLPSEPVDISTAMSERALAQKRLSENAFDLEAMSMLNRAQERIDAWAQLNSIPGQFTGSTGVQVLTQEQLANTGAQAWIKKDQFLRAAPVTGGMGAVLMRKMGWREGEGLGKNKEGNKEPILVDFKTDRKGLVAVGERAQKRSGNFSAAMKDLSGKHPVSALMEICNKRRWQPPEFLLVHDSGPDHRKHFLFRVLRNGALTRPNCMFFLNRY

SEQ ID NO: 64924 - protein, 1332 aa, Homo sapiens [sequence omitted]

SEQ ID NO: 64925 - protein, 1299 aa, Homo sapiens
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTGAFDGPLHSPPPPPPRDPLPDTPPPVPLRPPEHFINCPFNLQPPPLGHLHRDSDWLRDISTCPNSPSTPPSTPSPRVPRRCYVLSSSQNNLAHPPAPPVPPRQNSSPHLPKLPPKTYKRELSHPPLYRLPLLENAETPQ

SEQ ID NO: 64926 - protein, 462 aa, Homo sapiens
MLLLARCLLLVLVSSLLVCSGLACGPGRGFGKRRHPKKLTPLAYKQFIPNVAEKTLGASGRYEGKISRNSERFKELTPNYNPDIIFKDEENTGADRLMTQRCKDKLNALAISVMNQWPGVKLRVTEGWDEDGHHSEESLHYEGRAVDITTSDRDRSKYGMLARLAVEAGFDWVYYESKAHIHCSVKAENSVAAKSGGCFPGSATVHLEQGGTKLVKDLSPGDRVLAADDQGRLLYSDFLTFLDRDDGAKKVFYVIETREPRERLLLTAAHLLFVAPHNDSATGEPEASSGSGPPSGGALGPRALFASRVRPGQRVYVVAERDGDRRLLPAAVHSVTLSEEAAGAYAPLTAQGTILINRVLASCYAVIEEHSWAHRAFAPFRLAHALLAALAPARTDRGGDSGGGDRGGGGGRVALTAPGAADAPGAGATAGIHWYSQLLYQIGTWLLDSEALHPLGMAVKSS

SEQ ID NO: 64927 - protein, 1151 aa, Homo sapiens
MSSECDGGSKAVMNGLAPGSNGQDKATADPLRARSISAVKIIPVKTVKNASGLVLPTDMDLTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDTPEENPYFPTYKFPELPEIQQTSEETKSCSVMSPRLECSGTVIAHCSLKLLDSSNPPTSASQVAGTADDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQPWREESGQYERKAERGAGERGPGGPKISKKSCLKPSDVVRCLSTEQRLSDLNTPEESRPGKPLGSAFPGSEAEQTERHRGGEQAGRKAARRGGSQQPQAQQRRVTPDRSQTSQDLFSYQALYSYIPQNDDELELRDGDIVDVMEKCDDGWFVGTSRRTKQFGTFPGNYVKPLYL

SEQ ID NO: 64928 - protein, 781 aa, Homo sapiens
MSSECDGGSKAVMNGLAPGSNGQDKATADPLRARSISAVKIIPVKTVKNASGLVLPTDMDLTKICTGKGAVTLRASSSYRETPSSSPASPQETRQHESKPGLEPEPSSADEWRLSSSADANGNAQPSSLAAKGYRSVHPNLPSDKSQDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 64929 - protein, 846 aa, Homo sapiens
MSSECDGGSKAVMNGLAPGSNGQDKATADPLRARSISAVKIIPVKTVKNASGLVLPTDMDLTKICTGKGAVTLRASSSYRETPSSSPASPQETRQHESKPDEWRLSSSADANGNAQPSSLAAKGYRSVHPNLPSDKSQDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDTPEENPYFPTYKFPELPEIQQTSEEDNPYTPTYQFPASTPSPKSEDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 64930 - protein, 905 aa, Homo sapiens
MSSECDGGSKAVMNGLAPGSNGQDKATADPLRARSISAVKIIPVKTVKNASGLVLPTDMDLTKICTGKGAVTLRASSSYRETPSSSPASPQETRQHESKPGLEPEPSSADEWRLSSSADANGNAQPSSLAAKGYRSVHPNLPSDKSQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQLSHHSLRAGPDLTESEKSYVQPQAQQRRVTPDRSQTSQDLFSYQALYSYIPQNDDELELRDGDIVDVMEKCDDGWFVGTSRRTKQFGTFPGNYVKPLYL

SEQ ID NO: 64931 - protein, 1004 aa, Homo sapiens
MSSECDGGSKAVMNGLAPGSNGQDKATADPLRARSISAVKIIPVKTVKNASGLVLPTDMDLTKICTGKGAVTLRASSSYRETPSSSPASPQETRQHESKPDEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDTPEENPYFPTYKFPELPEIQQTSEDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 64932 - protein, 1292 aa, Homo sapiens
MSSECDGGSKAVMNGLAPGSNGQDKATADPLRARSISAVKIIPVKTVKNASGLVLPTDMDLTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDTPEENPYFPTYKFPELPEIQQTSEEDNPYTPTYQFPASTPSPKSEDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQFSSHSKLITPAPSSLPHSRRALSPEMHAVTSEWISLTVGVPGRRSLALTPPLPPLPEASIYNTDHLALSPRASPSLSLSLPHLSWSDRPTPRSVASPLALPSPHKTYSLAPTSQASLHMNGDGGVHTPSSGIHQDSFLQLPLGSSDSVISQLSDAFSSQSKRQPWREESGQYERKAERGAGERGPGGPKISKKSCLKPSDVVRCLSTEQRLSDLNTPEESRPGKPLGSAFPGSEAEQTERHRGGEQAGRKAARRGGSQQPQAQQRRVTPDRSQTSQDLFSYQALYSYIPQNDDELELRDGDIVDVMEKCDDGWFVGTSRRTKQFGTFPGNYVKPLYL

SEQ ID NO: 64933 - protein, 1266 aa, Homo sapiens
MSSECDGGSKAVMNGLAPGSNGQDKATADPLRARSISAVKIIPVKTVKNASGLVLPTDMDLTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQFSSHSKLITPAPSSLPHSRRALSPEMHAVTSEWISLTVGVPGRRSLALTPPLPPLPEASIYNTDHLALSPRASPSLSLSLPHLSWSDRPTPRSVASPLALPSPHKTYSLAPTSQASLHMNGDGGVHTPSSGIHQDSFLQLPLGSSDSVISQLSDAFSSQSKRQPWREESGQYERKAERGAGERGPGGPKISKKSCLKPSDVVRCLSTEQRLSDLNTPEESRPGKPLGSAFPGSEAEQTERHRGGEQAGRKAARRGGSQLSHHSLRAGPDLTESEKSYVQPQAQQRRVTPDRSQTSQDLFSYQALYSYIPQNDDELELRDGDIVDVMEKCDDGWFVGTSRRTKQFGTFPGNYVKPLYL

SEQ ID NO: 64934 - protein, 811 aa, Homo sapiens
MSSECDGGSKAVMNGLAPGSNGQDKDMDLTKICTGKGAVTLRASSSYRETPSSSPASPQETRQHESKPGLEPEPSSADEWRLSSSADANGNAQPSSLAAKGYRSVHPNLPSDKSQDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 64935 - protein, 684 aa, Homo sapiens
MSSECDGGSKAVMNGLAPGSNGQDKDMDLTKICTGKGAVTLRASSSYRETPSSSPASPQETRQHESKPDEWRLSSSADANGNAQPSSLAAKGYRSVHPNLPSDKSQDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 64936 - protein, 905 aa, Homo sapiens; identical to SEQ ID NO: 64930

SEQ ID NO: 64937 - protein, 1151 aa, Homo sapiens; identical to SEQ ID NO: 64927

SEQ ID NO: 64938 - protein, 1292 aa, Homo sapiens; identical to SEQ ID NO: 64932

SEQ ID NO: 64939 - protein, 816 aa, Homo sapiens
MSSECDGGSKAVMNGLAPGSNGQDKDMDLTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 64940 - protein, 1004 aa, Homo sapiens; identical to SEQ ID NO: 64931

SEQ ID NO: 64941 - protein, 671 aa, Homo sapiens
MQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKSSPAPRRAPEQRPPAGPASAWSSSYPHAPYLGSARSLSPHKMADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPIDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 64942 - protein, 329 aa, Homo sapiens
MADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPIDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 64943 - protein, 357 aa, Homo sapiens
MAAAAKPNNLSLVVHGPGDLRLENYPIPEPGPNEVLLRMHSVGICGSDVHYWEYGRIGNFIVKKPMVLGHEASGTVEKVGSSVKHLKPGDRVAIEPGAPRENDEFCKMGRYNLSPSIFFCATPPDDGNLCRFYKHNAAFCYKLPDNVTFEEGALIEPLSVGIHACRRGGVTLGHKVLVCGAGPIGMVTLLVAKAMGAAQVVVTDLSATRLSKAKEIGADLVLQISKESPQEIARKVEGQLGCKPEVTIECTGAEASIQAGIYATRSGGNLVLVGLGSEMTTVPLLHAAIREVDIKGVFRYCNTWPVAISMLASKSVNVKPLVTHRFPLEKALEAFETFKKGLGLKIMLKCDPSDQNP

SEQ ID NO: 64944 - protein, 198 aa, Homo sapiens
MAYPGHPGAGGGYYPGGYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 64945 - protein, 183 aa, Homo sapiens
MQYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 64946 - protein, 180 aa, Homo sapiens
MQYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDVSLRN

SEQ ID NO: 64947 - protein, 2214 aa, Homo sapiens
MATRSSRRESRLPFLFTLVALLPPGALCEVWTQRLHGGSAPLPQDRGFLVVQGDPRELRLWARGDARGASRADEKPLRRKRSAALQPEPIKVYGQVSLNDSHNQMVVHWAGEKSNVIVALARDSLALARPKSSDVYVSYDYGKSFKKISDKLNFGLGNRSEAVIAQFYHSPADNKRYIFADAYAQYLWITFDFCNTLQGFSIPFRAADLLLHSKASNLLLGFDRSHPNKQLWKSDDFGQTWIMIQEHVKSFSWGIDPYDKPNTIYIERHEPSGYSTVFRSTDFFQSRENQEVILEEVRDFQLRDKYMFATKVVHLLGSEQQSSVQLWVSFGRKPMRAAQFVTRHPINEYYIADASEDQVFVCVSHSNNRTNLYISEAEGLKFSLSLENVLYYSPGGAGSDTLVRYFANEPFADFHRVEGLQGVYIATLINGSMNEENMRSVITFDKGGTWEFLQAPAFTGYGEKINCELSQGCSLHLAQRLSQLLNLQLRRMPILSKESAPGLIIATGSVGKNLASKTNVYISSSAGARWREALPGPHYYTWGDHGGIITAIAQGMETNELKYSTNEGETWKTFIFSEKPVFVYGLLTEPGEKSTVFTIFGSNKENVHSWLILQVNATDALGVPCTENDYKLWSPSDERGNECLLGHKTVFKRRTPHATCFNGEDFDRPVVVSNCSCTREDYECDFGFKMSEDLSLEVCVPDPEFSGKSYSPPVPCPVGSTYRRTRGYRKISGDTCSGGDVEARLEGELVPCPLAEENEFILYAVRKSIYRYDLASGATEQLPLTGLRAAVALDFDYEHNCLYWSDLALDVIQRLCLNGSTGQEVIINSGLETVEALAFEPLSQLLYWVDAGFKKIEVANPDGDFRLTIVNSSVLDRPRALVLVPQEGVMFWTDWGDLKPGIYRSNMDGSAAYHLVSEDVKWPNGISVDDQWIYWTDAYLECIERITFSGQQRSVILDNLPHPYAIAVFKNEIYWDDWSQLSIFRASKYSGSQMEILANQLTGLMDMKIFYKGKNTGSNACVPRPCSLLCLPKANNSRSCRCPEDVSSSVLPSGDLMCDCPQGYQLKNNTCVKQENTCLRNQYRCSNGNCINSIWWCDFDNDCGDMSDERNCPTTICDLDTQFRCQESGTCIPLSYKCDLEDDCGDNSDESHCEMHQCRSDEYNCSSGMCIRSSWVCDGDNDCRDWSDEANCTAIYHTCEASNFQCRNGHCIPQRWACDGDTDCQDGSDEDPVNCEKKCNGFRCPNGTCIPSSKHCDGLRDCSDGSDEQHCEPLCTHFMDFVCKNRQQCLFHSMVCDGIIQCRDGSDEDAAFAGCSQDPEFHKVCDEFGFQCQNGVCISLIWKCDGMDDCGDYSDEANCENPTEAPNCSRYFQFRCENGHCIPNRWKCDRENDCGDWSDEKDCGDSHILPFSTPGPSTCLPNYYRCSSGTCVMDTWVCDGYRDCADGSDEEACPLLANVTAASTPTQLGRCDRFEFECHQPKTCIPNWKRCDGHQDCQDGRDEANCPTHSTLTCMSREFQCEDGEACIVLSERCDGFLDCSDESDEKACSDELTVYKVQNLQWTADFSGDVTLTWMRPKKMPSASCVYNVYYRVVGESIWKTLETHSNKTNTVLKVLKPDTTYQVKVQVQCLSKAHNTNDFVTLRTPEGLPDAPRNLQLSLPREAEGVIVGHWAPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVNGYVVNLFWAFDTHKQERRTLNFRGSILSHKVGNLTAHTSYEISAWAKTDLGDSPLAFEHVMTRGVRPPAPSLKAKAINQTAVECTWTGPRNVVYGIFYATSFLDLYRNPKSLTTSLHNKTVIVSKDEQYLFLVRVVVPYQGPSSDYVVVKMIPDSRLPPRHLHVVHTGKTSVVIKWESPYDSPDQDLLYAVAVKDLIRKTDRSYKVKSRNSTVEYTLNKLEPGGKYHIIVQLGNMSKDSSIKITTVSLSAPDALKIITENDHVLLFWKSLALKEKHFNESRGYEIHMFDSAMNITAYLGNTTDNFFKISNLKMGHNYTFTVQARCLFGNQICGEPAILLYDELGSGADASATQAARSTDVAAVVVPILFLILLSLGVGFAILYTKHRRLQSSFTAFANSHYSSRLGSAIFSSGDDLGEDDEDAPMITGFSDDVPMVIA

SEQ ID NO: 64948 - protein, 1168 aa, Homo sapiens
MGKVGAGGGSQARLSALLAGAGLLILCAPGVCGGGSCCPSPHPSSAPRSASTPRGFSHQGRPGRAPATPLPLVVRPLFSVAPGDRALSLERARGTGASMAVAARSGRRRRSGADQEKAERGEGASRSPRGVLRDGGQQEPGTRERDPDKATRFRMEELRLTSTTFALTGDSAHNQAMVHWSGHNSSVILILTKLYDYNLGSITESSLWRSTDYGTTYEKLNDKVGLKTILSYLYVCPTNKRKIMLLTDPEIESSLLISSDEGATYQKYRLNFYIQSLLFHPKQEDWILAYSQDQKLYSSAEFGRRWQLIQEGVVPNRFYWSVMGSNKEPDLVHLEARTVDGHSHYLTCRMQNCTEANRNQPFPGYIDPDSLIVQDHYVFVQLTSGGRPHYYVSYRRNAFAQMKLPKYALPKDMHVISTDENQVFAAVQEWNQNDTYNLYISDTRGVYFTLALENVQSSRGPEGNIMIDLYEVAGIKGMFLANKKIDNQVKTFITYNKGRDWRLLQAPDTDLRGDPVHCLLPYCSLHLHLKVSENPYTSGIIASKDTAPSIIVASGNIGSELSDTDISMFVSSDAGNTWRQIFEEEHSVLYLDQGGVLVAMKHTSLPIRHLWLSFDEGRSWSKYSFTSIPLFVDGVLGEPGEETLIMTVFGHFSHRSEWQLVKVDYKSIFDRRCAEEDYRPWQLHSQGEACIMGAKRIYKKRKSERKCMQGKYAGAMESEPCVCTEADFDCDYGYERHSNGQCLPAFWFNPSSLSKDCSLGQSYLNSTGYRKVVSNNCTDGVREQYTAKPQKCPGKAPRGLRIVTADGKLTAEQGHNVTLMVQLEEGDVQRTLIQVDFGDGIAVSYVNLSSMEDGIKHVYQNVGIFRVTVQVDNSLGSDSAVLYLHVTCPLEHVHLSLPFVTTKNKEVNATAVLWPSQVGTLTYVWWYGNNTEPLITLEGSISFRFTSEGMNTITVQVSAGNAILQDTKTIAVYEEFRSLRLSFSPNLDDYNPDIPEWRRDIGRVIKKSLVEATGVPGQHILVAVLPGLPTTAELFVLPYQDPAGENKRSTDDLEQISELLIHTLNQNSVHFELKPGVRVLVHAAHLTAAPLVDLTPTHSGSAMLMLLSVVFVGLAVFVIYKFKRRVALPSPPSPSTQPGDSSLRLQRARHATPPSTPKRGSAGAQYAI

SEQ ID NO: 64949 - protein, 1198 aa, Homo sapiens
MGKVGAGGGSQARLSALLAGAGLLILCAPGVCGGGSCCPSPHPSSAPRSASTPRGFSHQGRPGRAPATPLPLVVRPLFSVAPGDRALSLERARGTGASMAVAARSGRRRRSGADQEKAERGEGASRSPRGVLRDGGQQEPGTRERDPDKATRFRMEELRLTSTTFALTGDSAHNQAMVHWSGHNSSVILILTKLYDYNLGSITESSLWRSTDYGTTYEKLNDKVGLKTILSYLYVCPTNKRKIMLLTDPEIESSLLISSDEGATYQKYRLNFYIQSLLFHPKQEDWILAYSQDQKLYSSAEFGRRWQLIQEGVVPNRFYWSVMGSNKEPDLVHLEARTVDGHSHYLTCRMQNCTEANRNQPFPGYIDPDSLIVQDHYVFVQLTSGGRPHYYVSYRRNAFAQMKLPKYALPKDMHVISTDENQVFAAVQEWNQNDTYNLYISDTRGVYFTLALENVQSSRGPEGNIMIDLYEVAGIKGMFLANKKIDNQVKTFITYNKGRDWRLLQAPDTDLRGDPVHCLLPYCSLHLHLKVSENPYTSGIIASKDTAPSIIVASGNIGSELSDTDISMFVSSDAGNTWRQIFEEEHSVLYLDQGGVLVAMKHTSLPIRHLWLSFDEGRSWSKYSFTSIPLFVDGVLGEPGEETLIMTVFGHFSHRSEWQLVKVDYKSIFDRRCAEEDYRPWQLHSQGEACIMGAKRIYKKRKSERKCMQGKYAGAMESEPCVCTEADFDCDYGYERHSNGQCLPAFWFNPSSLSKDCSLGQSYLNSTGYRKVVSNNCTDGVREQYTAKPQKCPGKAPRGLRIVTADGKLTAEQGHNVTLMVQLEEGDVQRTLIQVDFGDGIAVSYVNLSSMEDGIKHVYQNVGIFRVTVQVDNSLGSDSAVLYLHVTCPLEHVHLSLPFVTTKNKEVNATAVLWPSQVGTLTYVWWYGNNTEPLITLEGSISFRFTSEGMNTITVQVSAGNAILQDTKTIAVYEEFRSLRLSFSPNLDDYNPDIPEWRRDIGRVIKKSLVEATGVPGQHILVAVLPGLPTTAELFVLPYQDPAGENKRSTDDLEQISELLIHTLNQNSVHFELKPGVRVLVHAAHLTAAPLVDLTPTHSGSAMLMLLSVVFVGLAVFVIYKFKRKIPGINVYAQMQNEKEQEMISPVSHSESRPNVPQTELRRPGQLIDEKVESQLIGSISIVAENQSTKEIPTYVNV

SEQ ID NO: 64950 - protein, 714 aa, Homo sapiens
MIDLYEVAGIKGMFLANKKIDNQVKTFITYNKGRDWRLLQAPDTDLRGDPVHCLLPYCSLHLHLKVSENPYTSGIIASKDTAPSIIVASGNIGSELSDTDISMFVSSDAGNTWRQIFEEEHSVLYLDQGGVLVAMKHTSLPIRHLWLSFDEGRSWSKYSFTSIPLFVDGVLGEPGEETLIMTVFGHFSHRSEWQLVKVDYKSIFDRRCAEEDYRPWQLHSQGEACIMGAKRIYKKRKSERKCMQGKYAGAMESEPCVCTEADFDCDYGYERHSNGQCLPAFWFNPSSLSKDCSLGQSYLNSTGYRKVVSNNCTDGVREQYTAKPQKCPGKAPRGLRIVTADGKLTAEQGHNVTLMVQLEEGDVQRTLIQVDFGDGIAVSYVNLSSMEDGIKHVYQNVGIFRVTVQVDNSLGSDSAVLYLHVTCPLEHVHLSLPFVTTKNKEVNATAVLWPSQVGTLTYVWWYGNNTEPLITLEGSISFRFTSEGMNTITVQVSAGNAILQDTKTIAVYEEFRSLRLSFSPNLDDYNPDIPEWRRDIGRVIKKSLVEATGVPGQHILVAVLPGLPTTAELFVLPYQDPAGENKRSTDDLEQISELLIHTLNQNSVHFELKPGVRVLVHAAHLTAAPLVDLTPTHSGSAMLMLLSVVFVGLAVFVIYKFKRKIPGINVYAQMQNEKEQEMISPVSHSESRPNVPQTELRRPGQLIDEKVESQLIGE

SEQ ID NO: 64951 - protein, 213 aa, Homo sapiens
  MOD_RES (1)..(1): Any amino acid
XLDDYNPDIPEWRRDIGRVIKKSLVEATGVPGQHILVAVLPGLPTTAELFVLPYQDPAGENKRSTDDLEQISELLIHTLNQNSVHFELKPGVRVLVHAAHLTAAPLVDLTPTHSGSAMLMLLSVVFVGLAVFVIYKFKRKIPGINVYAQMQNEKEQEMISPVSHSESRPNVPQTELRRPGQLIDEKVESQLIGSISIVAENQSTKEIPTYVNV

SEQ ID NO: 64952 - protein, 1002 aa, Homo sapiens
MGKVLESSLWRSSDFGTSYTKLTLQPGVTTVIDNFYICPTNKRKVILVSSSLSDRDQSLFLSADEGATFQKQPIPFFVETLIFHPKEEDKVLAYTKESKLYVSSDLGKKWTLLQERVTKDHVFWSVSGVDADPDLVHVEAQDLGGDFRYVTCAIHNCSEKMLTAPFAGPIDHGSLTVQDDYIFFKATSANQTKYYVSYRRNEFVLMKLPKYALPKDLQIISTDESQVFVAVQEWYQMDTYNLYQSDPRGVRYALVLQDVRSSRQAEESVLIDILEVRGVKGVFLANQKIDGKVMTLITYNKGRDWDYLRPPSMDMNGKPTNCKPPDCHLHLHLRWADNPYVSGTVHTKDTAPGLIMGAGNLGSQLVEYKEEMYITSDCGHTWRQVFEEEHHILYLDHGGVIVAIKDTSIPLKILKFSVDEGLTWSTHNFTSTSVFVDGLLSEPGDETLVMTVFGHISFRSDWELVKVDFRPSFSRQCGEEDYSSWELSNLQGDRCIMGQQRSFRKRKSTSWCIKGRSFTSALTSRVCECRDSDFLCDYGFERSSSSESSTNKCSANFWFNPLSPPDDCALGQTYTSSLGYRKVVSNVCEGGVDMQQSQVQLQCPLTPPRGLQVSIQGEAVAVRPGEDVLFVVRQEQGDVLTTKYQVDLGDGFKAMYVNLTLTGEPIRHRYESPGIYRVSVRAENTAGHDEAVLFVQVNSPLQALYLEVVPVIGLNQEVNLTAVLLPLNPNLTVFYWWIGHSLQPLLSLDNSVTTRFSDTGDVRVTVQAACGNSVLQDSRVLRVLDQFQVMPLQFSKELDAYNPNTPEWREDVGLVVTRLLSKETSVPQELLVTVVKPGLPTLADLYVLLPPPRPTRKRSLSSDKRLAAIQQVLNAQKISFLLRGGVRVLVALRDTGTGAEQLGGGGGYWAVVVLFVIGLFAAGAFILYKFKSRKRPGRTVYAQMHNEKEQEMTSPVSHSEDVQGAVQGEEFIDDDLDSQTLGNHSGVVLSINSREMHSYLVS

SEQ ID NO: 64953 - protein, 1159 aa, Homo sapiens
MAHRGPSRASKGPGPTARAPSPGAPPPPRSPRSRPLLLLLLLLGACGAAGRSPEPGRLGPHAQLTRVPRSPPAGRAEPGGGEDRQARGTEPGAPGPSPGPAPGPGEDGAPAAGYRRWERAAPLAGVASRAQVSLISTSFVLKGDATHNQAMVHWTGENSSVILILTKYYHADMGKVLESSLWRSSDFGTSYTKLTLQPGVTTVIDNFYICPTNKRKVILVSSSLSDRDQSLFLSADEGATFQKQPIPFFVETLIFHPKEEDKVLAYTKESKLYVSSDLGKKWTLLQERVTKDHVFWSVSGVDADPDLVHVEAQDLGGDFRYVTCAIHNCSEKMLTAPFAGPIDHGSLTVQDDYIFFKATSANQTKYYVSYRRNEFVLMKLPKYALPKDLQIISTDESQVFVAVQEWYQMDTYNLYQSDPRGVRYALVLQDVRSSRQAEESVLIDILEVRGVKGVFLANQKIDGKVMTLITYNKGRDWDYLRPPSMDMNGKPTNCKPPDCHLHLHLRWADNPYVSGTVHTKDTAPGLIMGAGNLGSQLVEYKEEMYITSDCGHTWRQVFEEEHHILYLDHGGVIVAIKDTSIPLKILKFSVDEGLTWSTHNFTSTSVFVDGLLSEPGDETLVMTVFGHISFRSDWELVKVDFRPSFSRQCGEEDYSSWELSNLQGDRCIMGQQRSFRKRKSTSWCIKGRSFTSALTSRVCECRDSDFLCDYGFERSSSSESSTNKCSANFWFNPLSPPDDCALGQTYTSSLGYRKVVSNVCEGGVDMQQSQVQLQCPLTPPRGLQVSIQGEAVAVRPGEDVLFVVRQEQGDVLTTKYQVDLGDGFKAMYVNLTLTGEPIRHRYESPGIYRVSVRAENTAGHDEAVLFVQVNSPLQALYLEVVPVIGLNQEVNLTAVLLPLNPNLTVFYWWIGHSLQPLLSLDNSVTTRFSDTGDVRVTVQAACGNSVLQDSRVLRVLDQFQVMPLQFSKELDAYNPNTPEWREDVGLVVTRLLSKETSVPQELLVTVVKPGLPTLADLYVLLPPPRPTRKRSLSSDKRLAAIQQVLNAQKISFLLRGGVRVLVALRDTGTGAEQLGGGGGYWAVVVLFVIGLFAAGAFILYKFKRKRPGRTVYAQMHNEKEQEMTSPVSHSEDVQGAVQGNHSGVVLSINSREMHSYLVS

SEQ ID NO: 64954 - protein, 197 aa, Homo sapiens
MGERKIFKKRKPGAQCALGRDHSGSVVSEPCVCANWDFECDYGYERHGESQCVPAFWYNPASPSKDCSLGQSYLNSTGYRRIVSNNCTDGLREKYTAKAQMCPGKAPRGLHVVTTDGRLVAEQGHNATFIILMEEGDLQRTNIQLDFGDGIAVSYANFSPIEDGIKHVYKSAGIFQVTAYAENNLGSDTAVLFLHVV

SEQ ID NO: 64955 - protein, 1222 aa, Homo sapiens
MEAARTERPAGRPGAPLVRTGLLLLSTWVLAGAEITWDATGGPGRPAAPASRPPALSPLSPRAVASQWPEELASARRAAVLGRRAGPELLPQQGGGRGGEMQVEAGGTSPAGERRGRGIPAPAKLGGARRSRRAQPPITQERGDAWATAPADGSRGSRPLAKGSREEVKAPRAGGSAAEDLRLPSTSFALTGDSAHNQAMVHWSGHNSSVILILTKLYDFNLGSVTESSLWRSTDYGTTYEKLNDKVGLKTVLSYLYVNPTNKRKIMLLSDPEMESSILISSDEGATYQKYRLTFYIQSLLFHPKQEDWVLAYSLDQKLYSSMDFGRRWQLMHERITPNRFYWSVAGLDKEADLVHMEVRTTDGYAHYLTCRIQECAETTRSGPFARSIDISSLVVQDEYIFIQVTTSGRASYYVSYRREAFAQIKLPKYSLPKDMHIISTDENQVFAAVQEWNQNDTYNLYISDTRGIYFTLAMENIKSSRGLMGNIIIELYEVAGIKGIFLANKKVDDQVKTYITYNKGRDWRLLQAPDVDLRGSPVHCLLPFCSLHLHLQLSENPYSSGRISSKETAPGLVVATGNIGPELSYTDIGVFISSDGGNTWRQIFDEEYNVWFLDWGGALVAMKHTPLPVRHLWVSFDEGHSWDKYGFTSVPLFVDGALVEAGMETHIMTVFGHFSLRSEWQLVKVDYKSIFSRHCTKEDYQTWHLLNQGEPCVMGERKIFKKRKPGAQCALGRDHSGSVVSEPCVCANWDFECDYGYERHGESQCVPAFWYNPASPSKDCSLGQSYLNSTGYRRIVSNNCTDGLREKYTAKAQMCPGKAPRGLHVVTTDGRLVAEQGHNATFIILMEEGDLQRTNIQLDFGDGIAVSYANFSPIEDGIKHVYKSAGIFQVTAYAENNLGSDTAVLFLHVVCPVEHVHLRVPFVAIRNKEVNISAVVWPSQLGTLTYFWWFGNSTKPLITLDSSISFTFLAEGTDTITVQVAAGNALIQDTKEIAVHEYFQSQLLSFSPNLDYHNPDIPEWRKDIGNVIKRALVKVTSVPEDQILIAVFPGLPTSAELFILPPKNLTERRKGNEGDLEQIVETLFNALNQNLVQFELKPGVQVIVYVTQLTLAPLVDSSAGHSSSAMLMLLSVVFVGLAVFLIYKFKRKIPWINIYAQVQHDKEQEMIGSVSQSENAPKITLSDFTEPEELLDKELDTRVIGGIATIANSESTKEIPNCTSV

SEQ ID NO: 64956 - protein, 153 aa, Homo sapiens [sequence omitted]

SEQ ID NO: 64957 - protein, 469 aa, Homo sapiens
MGTVHARSLEPLPSSGPDFGGLGEEAEFVEVEPEAKQEILENKDVVVQHVHFDGLGRTKDDIIICEIGDVFKAKNLIEVMRKSHEAREKLLRLGIFRQVDVLIDTCQGDDALPNGLDVTFEVTELRRLTGSYNTMVGNNEGSMVLGLKLPNLLGRAEKVTFQFSYGTKETSYGLSFFKPRPGNFERNFSVNLYKVTGQFPWSSLRETDRGMSAEYSFPIWKTSHTVKWEGVWRELGCLSRTASFAVRKESGHSLKSSLSHAMVIDSRNSSILPRRGALLKVNQELAGYTGGDVSFIKEDFELQLNKQLIFDSVFSASFWGGMLVPIGDKPSSIADRFYLGGPTSIRGFSMHSIGPQSEGDYLGGEAYWAGGLHLYTPLPFRPGQGGFGELFRTHFFLNAGNLCNLNYGEGPKAHIRKLAECIRWSYGAGIVLRLGNIARLELNYCVPMGVQTGDRICDGVQFGAGIRFL

SEQ ID NO: 64958 - protein, 259 aa, Homo sapiens
MSAEYSFPIWKTSHTVKWEGVWRELGCLSRTASFAVRKESGHSLKSSLSHAMVIDSRNSSILPRRGALLKVNQELAGYTGGDVSFIKEDFELQLNKQLIFDSVFSASFWGGMLVPIGDKPSSIADRFYLGGPTSIRGFSMHSIGPQSEGDYLGGEAYWAGGLHLYTPLPFRPGQGGFGELFRTHFFLNAGNLCNLNYGEGPKAHIRKLAECIRWSYGAGIVLRLGNIARLELNYCVPMGVQTGDRICDGVQFGAGIRFL

SEQ ID NO: 64959 - protein, 474 aa, Homo sapiens
MASGGGGCSASERLPPPFPGLEPESEGAAGGSEPEAGDSDTEGEDIFTGAAVVSKHQSPKITTSLLPINNGSKENGIHEEQDQEPQDLFADATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRWESRVTQYERDFERISTVVRKEVIRFEKEKSKDFKNHVIKYLETLLYSQQQLAKYWEAFLPEAKAIS

SEQ ID NO: 64960 - protein, 522 aa, Homo sapiens
MASGGGGCSASERLPPPFPGLEPESEGAAGGSEPEAGDSDTEGEDIFTGAAVVSKHQSPKITTSLLPINNGSKENGIHEEQDQEPQDLFADATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 64961 - protein, 457 aa, Homo sapiens
MASGGGGCSASERLPPPFPGLEPESEGAAGGSEPEAGDSDTEGEDIFTGAAVVSKHQSPKITTSLLPINNGSKENGIHEEQDQEPQDLFAGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 64962 - protein, 457 aa, Homo sapiens; identical to SEQ ID NO: 64961

SEQ ID NO: 64963 - protein, 1005 aa, Homo sapiens
MAARPSRATGPRGGQRSRVKPPPGRRLKEQLPPLAAARAVFAAATAVIMLTEASLSIWGWGSLGIVLFLITFGPFVIFYLTFYILCFVGGGLVVTLLFGKTNSEKYLEQCEHSFLPPTSPGVPKCLEEMKREARTIKIDRRLTGANIIDEPLQQVIQFSLRDYVQYWYYTLSDDESFLLEIRQTLQNALIQFATRSKEIDWQPYFTTRIVDDFGTHLRVFRKAQQKITEKDDQVKGTAEDLVDTFFEVEVEMEKEVCRDLVCTSPKDEEGFLRDLCEVLLYLLLPPGDFQNKIMRYFVREILARGILLPLINQLSDPDYINQYVIWMIRDSNCNYEAFMNIIKLSDNIGELEAVRDKAAEELQYLRSLDTAGDDINTIKNQINSLLFVKKVCDSRIQRLQSGKEINTVKLAANFGKLCTVPLDSILVDNVALQFFMDYMQQTGGQAHLFFWMTVEGYRVTAQQQLEVLLSRQRDGKHQTNQTKGLLRAAAVGIYEQYLSEKASPRVTVDDYLVAKLADTLNHEDPTPEIFDDIQRKVYELMLRDERFYPSFRQNALYVRMLAELDMLKDPSFRGSDDGDGESFNGSPTGSINLSLDDLSNVSSDDSVQLHAYISDTGVCNDHGKTYALYAITVHRRNLNSEEMWKTYRRYSDFHDFHMRITEQFESLSSILKLPGKKTFNNMDRDFLEKRKKDLNAYLQLLLAPEMMKASPALAHYVYDFLENKAYSKGKGDFARKMDTFVNPLRNSMRNVSNAVKSLPDSLAEGMTKMSDNMGKMSERLGQDIKQSFFKVPPLIPKTDSDPEHRRVSAQLDDNVDDNIPLRVMLLLMDEVFDLKERNQWLRRNIKNLLQQLIRATYGDTINRKIVDHVDWMTSPEQVADSVKRFRDAFWPNGILAEAVPCRDKSIRMRTRVAGKTKLLAIMPDELKHIIGAETTRKGILRVFEMFQHNQLNRRMVYVFLEGFLETLFPQYKFRELFNKLHSRSKQMQKYKQKLQTTQAPSLQKR

SEQ ID NO: 64964 - protein, 957 aa, Homo sapiens
MLTEASLSIWGWGSLGIVLFLITFGPFVIFYLTFYILCFVGGGLVVTLLFGKTNSEKYLEQCEHSFLPPTSPGVPKCLEEMKREARTIKIDRRLTGANIIDEPLQQVIQFSLRDYVQYWYYTLSDDESFLLEIRQTLQNALIQFATRSKEIDWQPYFTTRIVDDFGTHLRVFRKAQQKITEKDDQVKGTAEDLVDTFFEVEVEMEKEVCRDLVCTSPKDEEGFLRDLCEVLLYLLLPPGDFQNKIMRYFVREILARGILLPLINQLSDPDYINQYVIWMIRDSNCNYEAFMNIIKLSDNIGELEAVRDKAAEELQYLRSLDTAGDDINTIKNQINSLLFVKKVCDSRIQRLQSGKEINTVKLAANFGKLCTVPLDSILVDNVALQFFMDYMQQTGGQAHLFFWMTVEGYRVTAQQQLEVLLSRQRDGKHQTNQTKGLLRAAAVGIYEQYLSEKASPRVTVDDYLVAKLADTLNHEDPTPEIFDDIQRKVYELMLRDERFYPSFRQNALYVRMLAELDMLKDPSFRGSDDGDGESFNGSPTGSINLSLDDLSNVSSDDSVQLHAYISDTGVCNDHGKTYALYAITVHRRNLNSEEMWKTYRRYSDFHDFHMRITEQFESLSSILKLPGKKTFNNMDRDFLEKRKKDLNAYLQLLLAPEMMKASPALAHYVYDFLENKAYSKGKGDFARKMDTFVNPLRNSMRNVSNAVKSLPDSLAEGMTKMSDNMGKMSERLGQDIKQSFFKVPPLIPKTDSDPEHRRVSAQLDDNVDDNIPLRVMLLLMDEVFDLKERNQWLRRNIKNLLQQLIRATYGDTINRKIVDHVDWMTSPEQVADSVKRFRDAFWPNGILAEAVPCRDKSIRMRTRVAGKTKLLAIMPDELKHIIGAETTRKGILRVFEMFQHNQLNRRMVYVFLEGFLETLFPQYKFRELFNKLHSRSKQMQKYKQKLQTTQAPSLQKR

SEQ ID NO: 64965 - protein, 256 aa, Homo sapiens
MSRQAKDDFLRHYTVSDPRTHPKGYTEYKVTAQFISKKDPEDVKEVVVWKRYSDFRKLHGDLAYTHRNLFRRLEEFPAFPRAQVFGRFEASVIEERRKGAEDLLRFTVHIPALNNSPQLKEFFRGGEVTRPLEVSRDLHILPPPLIPTPPPDDPRLSQLLPAERRGLEELEVPVDPPPSSPAQEALDLLFNCESTEEASGSPARGPLTEAELALFDPFSKEGDPLPARQEGVKKKAAEYLKRAEEILRLHLSQLPP

SEQ ID NO: 64966 - protein, 342 aa, Homo sapiens
MSRQAKDDFLRHYTVSDPRTHPKGYTEYKVTAQFISKKDPEDVKEVVVWKRYSDFRKLHGDLAYTHRNLFRRLEEFPAFPRAQVFGRFEASVIEERRKGAEDLLRFTVHIPALNNSPQLKEFFRGGEVTRPLEVSRDLHILPPPLIPTPPPDDPRLSQLLPAERRGLEELEVPVDPPPSSPAQEALDLLFNCESTEEASGSPARGPLTEAELALFDPFSKEEGAAPSPTHVAELATMEVESARLDQEPWEPGGQEEEEDGEGGPTPAYLSQATELITQALRDEKAGAYAAALQGYRDGVHVLLQGVPSDPLPARQEGVKKKAAEYLKRAEEILRLHLSQLPP

SEQ ID NO: 64967 - protein, 470 aa, Homo sapiens
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 64968 - protein, 445 aa, Homo sapiens
MHFSIPETESRSGDSGGSAYVLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 64969 - protein, 256 aa, Homo sapiens
MENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 64970 - protein, 256 aa, Homo sapiens; identical to SEQ ID NO: 64969

SEQ ID NO: 64971 - protein, 519 aa, Homo sapiens
MAAEREPPPLGDGKPTDFEDLEDGEDLFTSTVSTLESSPSSPEPASLPAEDISANSNGPKPTEVVLDDDREDLFAEATEEVSLDSPEREPILSSEPSPAVTPVTPTTLIAPRIESKSMSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALERYLQRTVKHPTLLQDPDLRQFLESSELPRAVNTQALSGAGILRMVNKAADAVNKMTIKMNESDAWFEEKQQQFENLDQQLRKLHVSVEALVCHRKELSANTAAFAKSAAMLGNSEDHTALSRALSQLAEVEEKIDQLHQEQAFADFYMFSELLSDYIRLIAAVKGVFDHRMKCWQKWEDAQITLLKKREAEAKMMVANKPDKIQQAKNEIREWEAKVQQGERDFEQISKTIRKEVGRFEKERVKDFKTVIIKYLESLVQTQQQLIKYWEAFLPEAKAIA

SEQ ID NO: 64972 - protein, 129 aa, Homo sapiens
MASPEHPGSPGCMGPITQCTARTQQEAPATGPDLPHPGPDGHLDTHSGLSSNSSMTTRELQQYWQNQKCRWKHVKLLFEIASARIEERKVSKFVMGKSRPGEMTYPGSRGETGTAPEPDPRCPRQSDML

SEQ ID NO: 64973 - protein, 316 aa, Homo sapiens
MASPEHPGSPGCMGPITQCTARTQQEAPATGPDLPHPGPDGHLDTHSGLSSNSSMTTRELQQYWQNQKCRWKHVKLLFEIASARIEERKVSKFVVYQIIVIQTGSFDNNKAVLERRYSDFAKLQKALLKTFREEIEDVEFPRKHLTGNFAEEMICERRRALQEYLGLLYAIRCVRRSREFLDFLTRPELREAFGCLRAGQYPRALELLLRVLPLQEKLTAHCPAAAVPALCAVLLCHRDLDRPAEAFAAGERALQRLQAREGHRYYAPLLDAMVRLAYALGKDFVTLQERLEESQLRRPTPRGITLKELTVREYLH

SEQ ID NO: 64974 - protein, 152 aa, Homo sapiens
MASPEHPGSPGCMGPITQCTARTQQEAPATGPDLPHPGPDGHLDTHSGLSSNSSMTTRELQQYWQNQKCRWKHVKLLFEIASARIEERKVSKFVVYQIIVIQTGSFDNNKAVLERRYSDFVTLQERLEESQLRRPTPRGITLKELTVREYLH

SEQ ID NO: 64975 - protein, 102 aa, Homo sapiens
MASPEHPGSPGCMGPITQCTARTQQEAPATGPDLPHPGPDGHLDTHSGLSSNSSMTTRELQQYWQNQKCRWKHVKLLFEIASARIEERKVSKFVAPAPDATP

SEQ ID NO: 64976 - protein, 162 aa, Homo sapiens
MAETVADTRRLITKPQNLNDAYGPPSNFLEIDVSNPQTVGVGRGRFTTYEIRVKTNLPIFKLKESTVRRRYSDFEWLRSELERESKVVVPPLPGKAFLRQLPFRGDDGIFDDNFIEERKQGLEQFINKVAGHPLAQNERCLHMFLQDEIIDKSYTPSKIRHA

SEQ ID NO: 64977 - protein, 140 aa, Homo sapiens
MAETVADTRRLITKPQNLNDAYGPPSNFLEIDTNLPIFKLKESTVRRRYSDFEWLRSELERESKVVVPPLPGKAFLRQLPFRGDDGIFDDNFIEERKQGLEQFINKVAGHPLAQNERCLHMFLQDEIIDKSYTPSKIRHA

SEQ ID NO: 64978 - protein, 113 aa, Homo sapiens
MAETVADTRRLITKPQNLNDAYGPPSNFLEIDVSNPQTVGVGRGRFTTYEIRVKTNLPIFKLKESTVRRRYSDFEWLRSELERESKPCLRMTSEARSHGRTWCAQNDEKLFCD

SEQ ID NO: 64979 - protein, 130 aa, Homo sapiens
MAETVADTRRLITKPQNLNDAYGPPSNFLEIDVSNPQTVGVGRGRFTTYEIRVKVVVPPLPGKAFLRQLPFRGDDGIFDDNFIEERKQGLEQFINKVAGHPLAQNERCLHMFLQDEIIDKSYTPSKIRHA
